US010238093B2

(12) United States Patent
Macdonald et al.

(10) Patent No.: US 10,238,093 B2
(45) Date of Patent: *Mar. 26, 2019

(54) HUMANIZED NON-HUMAN ANIMALS WITH RESTRICTED IMMUNOGLOBULIN HEAVY CHAIN LOCI

(71) Applicant: Regeneron Pharmaceuticals, Inc., Tarrytown, NY (US)

(72) Inventors: Lynn Macdonald, Harrison, NY (US); John McWhirter, Tarrytown, NY (US); Sean Stevens, Del Mar, CA (US); Andrew J. Murphy, Croton-on-Hudson, NY (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/788,997

(22) Filed: Mar. 7, 2013

(65) Prior Publication Data

US 2013/0333057 A1  Dec. 12, 2013

Related U.S. Application Data

(60) Provisional application No. 61/658,466, filed on Jun. 12, 2012, provisional application No. 61/663,131, filed on Jun. 22, 2012.

(51) Int. Cl.
*C07K 16/46* (2006.01)
*C12P 21/02* (2006.01)
*A01K 67/027* (2006.01)

(52) U.S. Cl.
CPC ........ *A01K 67/0278* (2013.01); *C07K 16/461* (2013.01); *C12P 21/02* (2013.01); *A01K 2207/15* (2013.01); *A01K 2217/072* (2013.01); *A01K 2227/105* (2013.01)

(58) Field of Classification Search
CPC .......... A01K 67/0278; A01K 2227/105; A01K 2217/072; A01K 2207/15; C07K 16/461; C12P 21/02
USPC ........................................................ 800/18
See application file for complete search history.

(56) References Cited

U.S. PATENT DOCUMENTS

| | | |
|---|---|---|
| 5,545,807 A | 8/1996 | Surani et al. |
| 6,162,963 A | 12/2000 | Kucherlapati et al. |
| 6,586,251 B2 | 7/2003 | Economides et al. |
| 6,596,541 B2 * | 7/2003 | Murphy et al. ............... 435/463 |
| 6,657,103 B1 * | 12/2003 | Kucherlapati et al. ........... 800/6 |
| 6,673,986 B1 | 1/2004 | Kucherlapati et al. |
| 7,105,348 B2 | 9/2006 | Murphy et al. |
| 7,183,076 B2 | 2/2007 | Arathoon et al. |
| 7,501,552 B2 | 3/2009 | Lonberg et al. |
| 7,582,298 B2 | 9/2009 | Stevens et al. |
| 7,910,798 B2 | 3/2011 | Tanamachi et al. |
| 8,158,419 B2 | 4/2012 | Lonberg et al. |
| 8,502,018 B2 | 8/2013 | Murphy et al. |
| 8,642,835 B2 * | 2/2014 | Macdonald ........ A01K 67/0278 800/16 |
| 8,697,940 B2 * | 4/2014 | Macdonald ........ A01K 67/0278 800/16 |
| 8,754,287 B2 | 6/2014 | MacDonald et al. |
| 9,932,408 B2 * | 4/2018 | Macdonald ........ A01K 67/0278 |
| 9,944,716 B2 | 4/2018 | Macdonald et al. |
| 2002/0106628 A1 | 8/2002 | Economides et al. |
| 2002/0106629 A1 | 8/2002 | Murphy et al. |
| 2003/0108925 A1 | 6/2003 | Dix et al. |
| 2003/0109021 A1 | 6/2003 | Wu et al. |
| 2004/0018626 A1 | 1/2004 | Murphy et al. |
| 2006/0015957 A1 | 1/2006 | Lonberg et al. |
| 2006/0015958 A1 | 1/2006 | Kuroiwa et al. |
| 2006/0199204 A1 | 9/2006 | Dix et al. |
| 2008/0196922 A1 | 8/2008 | Van Marion et al. |
| 2008/0267982 A1 | 10/2008 | Kiselev et al. |
| 2010/0146647 A1 | 6/2010 | Logtenberg et al. |
| 2011/0111406 A1 | 5/2011 | Igawa et al. |
| 2011/0145937 A1 | 6/2011 | MacDonald et al. |
| 2011/0195454 A1 | 8/2011 | McWhirter et al. |
| 2011/0236378 A1 | 9/2011 | Green et al. |
| 2011/0314563 A1 | 12/2011 | Craig et al. |
| 2012/0021409 A1 | 1/2012 | McWhirter et al. |
| 2012/0047585 A1 | 2/2012 | Rohrer et al. |
| 2012/0096572 A1 | 4/2012 | Macdonald et al. |
| 2012/0167237 A1 | 6/2012 | Bradley et al. |
| 2012/0204278 A1 | 8/2012 | Bradley et al. |
| 2012/0272344 A1 | 10/2012 | Tanamachi et al. |
| 2012/0322108 A1 | 12/2012 | Macdonald et al. |
| 2013/0096287 A1 | 4/2013 | Macdonald et al. |
| 2013/0198879 A1 | 8/2013 | McWhirter et al. |
| 2013/0243759 A1 | 9/2013 | Friedrich et al. |
| 2013/0243773 A1 | 9/2013 | Van Berkel et al. |

(Continued)

FOREIGN PATENT DOCUMENTS

CN  1203922 A  1/1999
JP  2004-524841 A  8/2004
(Continued)

OTHER PUBLICATIONS

Featherstone et al. (2010) J. Biol. Chem., vol. 285(13) 9327-9338.*

(Continued)

*Primary Examiner* — Anne Marie S Wehbe
(74) *Attorney, Agent, or Firm* — Choate, Hall & Stewart LLP; Brenda Herschbach Jarrell; Stephanie L. Schonewald

(57) ABSTRACT

Mice, embryos, cells, and tissues having a restricted immunoglobulin heavy chain locus and an ectopic sequence encoding one or more ADAM6 proteins are provided. In various embodiments, mice are described that have humanized endogenous immunoglobulin heavy chain loci and are capable of expressing an ADAM6 protein or ortholog or homolog or functional fragment thereof that is functional in a male mouse. Mice, embryos, cells, and tissues having an immunoglobulin heavy chain locus characterized by a single human $V_H$ gene segment, a plurality of human $D_H$ gene segments and a plurality of human $J_H$ gene segments and capable expressing an ADAM6 protein or ortholog or homolog or functional fragment thereof are also provided.

27 Claims, 10 Drawing Sheets

Specification includes a Sequence Listing.

(56) References Cited

U.S. PATENT DOCUMENTS

| | | | |
|---|---|---|---|
| 2013/0263292 | A1 | 10/2013 | Liang et al. |
| 2013/0323235 | A1* | 12/2013 | Craig et al. ............... 424/133.1 |
| 2013/0323791 | A1 | 12/2013 | Macdonald et al. |
| 2014/0245468 | A1 | 8/2014 | McWhirter et al. |
| 2015/0020224 | A1 | 1/2015 | McWhirter et al. |
| 2015/0201589 | A1 | 7/2015 | Macdonald et al. |
| 2015/0210776 | A1 | 7/2015 | Macdonald et al. |
| 2015/0250152 | A1 | 9/2015 | Jakobovits et al. |

FOREIGN PATENT DOCUMENTS

| | | |
|---|---|---|
| KR | 1020050042792 A | 5/2005 |
| RU | 010506 U1 | 8/1999 |
| WO | WO-1990/04036 A1 | 4/1990 |
| WO | WO-91/000906 A1 | 1/1991 |
| WO | WO-1998/24893 A2 | 6/1998 |
| WO | WO-00/073323 A2 | 12/2000 |
| WO | WO-02/46237 A2 | 6/2002 |
| WO | WO-2002/066630 A1 | 8/2002 |
| WO | WO-2004/106375 A1 | 12/2004 |
| WO | WO-2005/028510 A2 | 3/2005 |
| WO | WO-2006/117699 A2 | 11/2006 |
| WO | WO-2007/003323 A1 | 1/2007 |
| WO | WO-2007/117410 A2 | 10/2007 |
| WO | WO-2009/076464 A2 | 6/2009 |
| WO | WO-2009/097006 A2 | 8/2009 |
| WO | WO-2010/039900 A2 | 4/2010 |
| WO | WO-2011/004192 A1 | 1/2011 |
| WO | WO-2011/072204 A1 | 6/2011 |
| WO | WO-2011/158009 A1 | 12/2011 |
| WO | WO-2012/063048 A1 | 5/2012 |
| WO | WO-2012/141798 A1 | 10/2012 |
| WO | WO-2013/022782 A1 | 2/2013 |
| WO | WO-2013/041844 A2 | 3/2013 |
| WO | WO-2013/041845 A2 | 3/2013 |
| WO | WO-2013/041846 A2 | 3/2013 |
| WO | WO-2013/045916 A1 | 4/2013 |
| WO | WO-2013/059230 A1 | 4/2013 |
| WO | WO-2013/061078 A1 | 5/2013 |
| WO | WO-2013061098 A2 | 5/2013 |
| WO | WO-2013/079953 A1 | 6/2013 |
| WO | WO-2013/144566 A2 | 10/2013 |
| WO | WO-2013/144567 A1 | 10/2013 |
| WO | WO-2013/171505 A2 | 11/2013 |
| WO | WO-2013/187953 A1 | 12/2013 |
| WO | WO-2014/130690 A1 | 8/2014 |

OTHER PUBLICATIONS

Han et al. (2009) Biol. Reprod., vol. 80, 1001-1008.*
Mageed et al. (2001) Clin. Exp. Immunol., vol. 123, 1-8.*
Forconi et al. (2010) Blood, vol. 115(1), 71-77.*
International Search Report for PCT/US2013/029624 (9 pages), dated Aug. 2, 2013.
Suarez et al., "Rearrangement of only one human IGHV gene is sufficient to generate a wide repertoire of antigen specific antibody responses in transgenic mice," Molecular Immunology, 43(11): 1827-1835, 2006.
Written Opinion for PCT/US2013/029624 (12 pages), dated Aug. 2, 2013.
Communication Relating to the Results of the Partial International Search for PCT/US2013/029624 (9 pages), dated May 17, 2013.
Featherstone K. et al., The mouse immunoglobulin heavy chain V-D intergenic sequence contains insulators that may regulate ordered V(D)J recombination, The Journal of Biological Chemistry, 285(13):9327-38 (2010).
Han C. et al., Comprehensive analysis of reproductive ADAMs: relationship of ADAM4 and ADAM6; with an ADAM complex required for fertilization in mice, Biology of Reproduction, 80(5):1001-8 (2009).
Mageed et al., "Rearrangement of the human heavy chain variable region gene V3-23 in transgenic mice generates antibodies reactive with a range of antigens on the basis of VHCDR3 and residues intrinsic to the heavy chain variable region," Clinical and Experimental Immunology, 123(1): 1-8, 2001.
Tuaillon, Nadine, "Repertoire analysis in human immunoglobulin heavy chain minilocus transgenic, [mu]MT/[mu]MT mice," Molecular Immunology, 37(5): 221-231, 2000.
Wagner et al., "The Diversity of Antigen-Specific Monoclonal Antibodies from Transgenic Mice Bearing Human Immunoglobulin Gene Miniloci," European Journal of Immunology, 24: 2672-2681, 1994.
Xu, et al., "Diversity in the CDR3 region of VH is sufficient for most antibody specificities," Immunity, 13(1): 37-45, 2000.
Lonberg, N., Human antibodies from transgenic animals, Nature Biotechnology, 23(9): 1117-1125 (2005).
Ray, Ectopic expression of a c-kitW42 minigene in transgenic mice: recapitulation of W phenotypes and evidence for c-kit function in melanoblast progenitors, Genes Dev., 5(12A): 2265-73, 1991.
Choi, I. et al., Characterization and comparative genomic analysis of intronless Adams with testicular gene expression, Genomics, 83(4):636-46 (2004).
Edwards D.R. et al., The ADAM metalloproteinases, Molecular Aspects of Medicine, 29(5):258-89 (2008).
Giallourakis C.C. et al., Elements between the IgH variable (V) and diversity (D) clusters influence antisense transcription and lineage-specific V(D)J recombination, Proceedings of the National Academy of Sciences of the United States of America, 107(51):22207-12 (2010).
Hendricks J. et al., Organization of the variable region of the immunoglobulin heavy-chain gene locus of the rat, Immunogenetics,62(7):479-86 (2010).
International Search Report and Written Opinion for PCT/US2012/026416, 12 pages (dated Jun. 25, 2012).
International Search Report and Written Opinion for PCT/US2012/060487, 14 pages (dated Feb. 1, 2013).
Kim T. et al., Expression and relationship of male reproductive ADAMs in mouse, Biology of Reproduction, 74(4):744-50 (2006).
Seals D.F. and Courtneidge S.A., The ADAMs family of metal-loproteases: multidomain; proteins with multiple functions, Genes and Development, 17(1):7-30 (2003).
Communication in Cases for which No Other Form is Applicable for PCT/US2012/026416, 9 pages (dated Jun. 7, 2013).
Communication in Cases for which No Other Form is Applicable for PCT/US2012/069981, 18 pages (dated Jul. 3, 2013).
Adderson et al., "Restricted Ig H Chain V Gene Usage in the Human Antibody Response to *Haemophilus influenzae* Type b Capsular Polysaccharide," The Journal of Immunology, 147: 1667-1674, 1991.
Adderson et al., "Restricted Immunoglobulin VH Usage and VDJ Combinations in the Human Response to Haemophilus influenzae Type b Capsular Polysaccharide," J. Clin. Invest., 91: 2734-2743, 1993.
Bando et al., "Characterization of $V_H\epsilon$ gene expressed in PBL from children with atopic diseases: detection of homologous $V_H$1-69 derived transcripts from three unrelated patients," Immunology Letters, 94: 99-106, 2004.
Baseggio et al., "CD5 expression identifies a subset of splenic marginal zone lymphomas with higher lymphocytosis: a clinico-pathological, cytogenetic and molecular study of 24 cases," Haematologica, 95(4): 604-612, 2010.
Berberian et al., "A VH Clonal Deficit in Human Immunodeficiency Virus-Positive Individuals Reflects a B-Cell Maturational Arrest," Blood, 78(1): 175-179, 1991.
Brezinschek et al., "Analysis of the Heavy Chain Repertoire of Human Peripheral B Cells Using Single-Cell Polymerase Chain Reaction," Journal of Immunology, 155: 190-202, 1995.
Bruggemann et al., "A repertoire of monoclonal antibodies with human heavy chains from transgenic mice," Proc. Natl. Acad. Sci. USA, 86: 6709-6713, 1989.
Bruggemann, Marianne, "Human Antibody Expression in Transgenic Mice," Archivum Immunologiae et Therapiae Experimentalis, 49: 203-208, 2001.

(56) References Cited

OTHER PUBLICATIONS

Carbonari et al., "Hepatitis C Virus Drives the Unconstrained Monoclonal Expansion of $V_H1$-69-Expressing Memory B Cells in Type II Cryoglobulinemia: A Model of Infection-Driven Lymphomagenesis," The Journal of Immunology, 174: 6532-6539, 2005.

Chan et al., "$V_H1$-69 gene is preferentially used by hepatitis C virus-associated B cell lymphomas and by normal B cells responding to the E2 viral antigen," Blood, 97(4): 1023-1026, 2001.

Charles et al., "A flow cytometry-based strategy to identify and express IgM from VH1-69+clonal peripheral B cells," Journal of Immunological Methods, 363: 210-220, 2011.

Davidkova et al., "Selective Usage of VH Genes in Adult Human B Lymphocyte Repertoires," Scand. J. Immunol., 45: 62-73, 1997.

De Wildt et al., "Analysis of Heavy and Light Chain Pairings Indicates that Receptor Editing Shapes the Human Antibody Repertoire," J. Mol. Biol., 285: 895-901, 1999.

Huang et al., "A Majority of Ig H Chain cDNA of Normal Human Adult Blood Lymphocytes Resembles cDNA for Fegal Ig and Natural Autoantibodies," The Journal of Immunology, 151(10): 5290-5300, 1993.

Johnson et al., "Ig $V_H1$ Genes Expressed in B Cell Chronic Lymphocytic Leukemia Exhibit Distinctive Molecular Features," The Journal of Immunology, 158: 235-246, 1997.

Kantor et al., "An Unbiased Analysis of $V_H$-D-$J_H$ Sequences from B-1a, B-1b, and Conventional B Cells," The Journal of Immunology, 158: 1175-1186, 1997.

Kunert et al., "Characterization of Molecular Features, Antigen-Binding, and in Vitro Properties of IgG and IgM Variants of 4E10, an Anti-HIV Type 1 Neutralizing Monoclonal Antibody," Aids Research and Human Retroviruses, 20(7): 755-762, 2004.

Lefranc et al., "Nomenclature of the Human Immunoglobulin Genes," Current Protocols in Immunology, A.1P.1-A.1P.37, 2000.

Mahmoud et al., "Limiting CDR-H3 Diversity Abrogates the Antibody Response to the Bacterial Polysaccharide α 1→3 Dextran," The Journal of Immunology, 187: 879-886, 2011.

Mahmoudi et al., "V region gene analysis of human IgM hybridoma monoclonal anti-Sm antibodies," Lupus, 6: 578-589, 1997.

Marasca et al., "Immunoglobulin Gene Mutations and Frequent Use of VH1-69 and VH4-34 Segments in Hepatitis C Virus-Positive and Hepatitis C Virus-Negative Nodal Marginal Zone B-Cell Lymphoma," American Journal of Pathology, 159(1): 253-261, 2001.

Miklos et al., "Salivary gland mucosa-associated lymphoid tissue lymphoma immunoglobulin $V_H$ genes show frequent use of V1-69 with distinctive CDR3 features," Blood, 95: 3878-3884, 2000.

Mortari et al., "Human Cord Blood Antibody Repertoire," The Journal of Immunology, 150(4): 1348-1357, 1993.

Muller et al., "B-Cell Abnormalities in AIDS: Stable and Clonally-Restricted Antibody Response in HIV-1 Infection," Scand. J. Immunol., 38: 327-334, 1993.

Perez et al., "Primary cutaneous B-cell Lymphoma is associated with somatically hypermutated immunoglobulin variable genes and frequent use of VH1-69 and VH4-59 segments," British Journal of Dermatopathology, 162: 611-618, 2010.

Pos et al., "VH1-69 germline encoded antibodies directed towards ADAMTS13 in patients with acquired thrombotic thrombocytopenic purpura," Journal of Thrombosis and Haemostatis, 7: 421-428, 2008.

Rodriguez et al., "High-efficiency deleter mice show that FLPe is an alternative to Cre-loxP," Nature Genetics, 25: 139-140, 2000.

Sasso et al., "A Fetally Expressed Immunoglobulin $V_H1$ Gene Belongs to a Complex Set of Alleles," J. Clin. Invest., 91: 2358-2367, 1993.

Sasso et al., "Expression of the Immunoglobulin $V_H$ Gene 51p1 is Proportional to its Germline Gene Copy Number," J. Clin. Invest., 97(9): 2074-2080, 1996.

Sasso et al., "Prevalence and Polymorphism of Human $V_H3$ Genes," The Journal of Immunology, 145(8): 2751-2757, 1990.

Schelonka et al., "A Single DH Gene Segment Creates Its Own Unique CDR-H3 Repertoire and Is Sufficient for B Cell Development and Immune Function," The Journal of Immunology, 175: 6624-6632, 2005.

Sibilia et al., "Structural Analsys of Human Antibodies to Proteinase 3 from Patients with Wegener Granulomatosis," The Journal of Immunology, 159: 712-719, 1997.

Souroujon et al., "Polymorphisms in Human H Chain V Region Genes from the $V_H$III Gene Family," The Journal of Immunology, 143(2): 706-711, 1989.

Sui et al., "Structural and functional bases for broad-spectrum neutralization of avian and human influenza A viruses," Nature Structural & Molecular Biology, 16(3): 265-273, 2009.

Suzuki et al., "Representation of Rearranged $V_H$ Gene Segments in the Human Adult Antibody Repertoire," The Journal of Immunology, 154: 3902-3911, 1995.

Taylor L.D. et al., A transgenic mouse that expresses a diversity of human sequence heavy and light chain immunoglobulins, Nucleic Acids Research, 20(23): 6287-6295, 1992.

Tuaillon et al., "Human immunoglobulin heavy-chain minilocus recombination in transgenic mice: Gene-segment use in μ and γ transcripts," Proc. Natl. Acad. Sci. USA, 90: 3720-3724, 1993.

Wagner et al., "Antibodies generated from human immunoglobulin miniloci in transgenic mice," Nucleic Acids Research, 22(8): 1389-1393, 1994.

Wang et al., "Universal epitopes of influenza virus hemagglutinins?," Nature Structural & Molecular Biology, 16(3): 233-234, 2009.

Yamada et al., "Preferential Utilization of Specific Immunoglobulin Heavy Chain Diversity and Joining Segments in Adult Human Peripheral Blood B Lymphocytes," J. Exp. Med., 173: 395-407, 1991.

Moran, Nuala, "Mouse platforms jostle for slice of humanized antibody market," Nature Biotechnology, vol. 31(4): 267-268, 2013.

Bendig, Humanization of Rodent Monoclonal Antibodies by CDR Graftng, Methods, 8: 83-93 (1995).

Briney, B. S. et al., Human Peripheral Blood Antibodies with Long HCDR3s Are Established Primarily at Original Recombination Using a Limited Subset of Germline Genes, PLoS ONE, 7(5): 1-13 (2012).

Chothia, C., et al., Structural Repertoire of the Human VH Segments, J. Mol. Biol., 227: 799-817. (1992).

Clark, et al., A future for transgenic livestock, Nature Reviews Genetics, 4: 825-833 (2003).

International Search Report for PCT/US2014/017427, 4 pages (dated Aug. 1, 2014).

Matsuda, F. et al., The Complete Nucleotide Sequence of the Human Immunoglobulin Heavy Chain Variable Region Locus, J. Exp. Med., 188(11): 2151-2162 (1998).

Munoz et al., Constraints to Progress in Embryonic Stem Cells from Domestic Species, Stem Cell Rev. and Rep, 5: 6-9 (2009).

Niemann, et al., Transgenic farm animals: present and future, Rev. Sci Tech. Off. Int. Epiz., 24(1): 285-298 (2005).

Paul, Fv Structure and Diversity in Three Dimensions, Fundamental Immunology, Third Edition, 292-295 (1993).

Prelle, et al., Pluripotent Stem Cells—Model of Embryonic Development, Tools for Gene Targeting, and Basis of Cell Therapy, Anat. Histol. Embryol., 31: 169-186 (2002).

Romo-González, T. and Vargas-Madrazo, E., Structural analysis of substitution patterns in alleles of human immunoglobulin VH genes, Molecular Immunology, 42: 1085-1097 (2005).

Tobin, et al., Subsets with restricted immunoglobulin gene rearrangement features indicate a role for antigen selection in the development of chronic lymphocytic leukemia, Blood, 104: 2879-2885 (2004).

Wagner, et al., Antibody Expression from the Core Region of the Human IgH Locus Reconstructed in Transgenic Mice Using Bacteriophage P1 Clones, Genomics, 35: 405-414 (1996).

Wheeler, et al., Transgenic Technology and Applications in Swine, Theriogenology, 56: 1345-1369 (2001).

Widhopf, et al., Chronic lymphocytic leukemia B cells of more than 1% of patients express virtually identical immunoglobulins, Blood, 104: 2499-2504 (2004).

(56) References Cited

OTHER PUBLICATIONS

Written Opinion for PCT/US2014/017427, 30 pages (dated Aug. 1, 2014).
Defrancesco, Laura, Transgenic Mice That Produce Fully Humanized Antibodies—Abgenix Granted Patent, Bioprocess Online, 2 pages (Aug. 23, 1999).
Genbank Accession No. AAA53514.1, GI: 553403, 1 page, first referenced Jul. 30, 1993, updated Nov. 23, 1994.
Mendez, M. et al., Functional transplant of megabase human immunoglobulin loci recapitulates human antibody response in mice, Nature Genetics, 15:146-156 (1997).
Murphy, A., Declaration Under 37 C.F.R. §1.132, 4 pages (2014).
Murphy, D., BAC-based Modifications of the Mouse Genome: The Big and the Backward, Wellcome Trust Advanced Course: Genetic Manipulation of ES Cells, 58 pages (2009).
Office Action for U.S. Appl. No. 14/137,902, 23 pages (dated Oct. 30, 2015).
Timetable for Mouse ES Cells course at Wellcome Trust Sanger Institute Oct. 26, 2009-Nov. 8, 2009 (black and white).
Timetable for Mouse ES Cells course at Wellcome Trust Sanger Institute Oct. 26, 2009-Nov. 8, 2009 (greyscale).
UniProtKB/Swiss-Prot Accession No. P23083, HV103_HUMAN, 7 pages, integrated into UniProtKB/Swiss-Prot Nov. 1, 1991, last modified Nov. 11, 2015, last accessed Dec. 9, 2015 <http://www.uniprot.org/uniprot/P23083>.
Amit, M. and Itskovitz-Eldor, J., Embryonic Stem Cells: Isolation, Characterization and Culture, Adv Biochem Engin/Biotechnol, 114:173-184 (2009).
Appeal by Opponent for EP 12716101.6, 14 pages (Jun. 20, 2016).
Astellas Negotiates $295M License Extension to Regeneron's VelocImmune mAb Platform, GEN News Highlights, Jul. 28, 2010.
Brouwers, B. et al., Unexpected Phenotypes in Mouse Models Carrying the Human Growth Hormone Minigene to Enhance Transgene Expression, Journal of Steroids & Hormonal Science, 6(2): 2 pages (2015).
Bruggemann, M. and Neuberger, M., Strategies for expressing human antibody repertoires in transgenic mice, Review Immunology Today, 192(17):391-397 (1996).
Butler, J.E., Immunoglobulin diversity, B-cell and antibody repertoire development in large farm animals, Rev. Sci. Tech. Off. Int. Epiz., 17(1):43-70(1998).
Canadian Office Action for Application No. 2,820,824, 3 pages, dated Aug. 5, 2014.
Cheval, L. et al., Of Mice and Men: Divergence of Gene Expression Patterns in Kidney, PLoS One, 7(10):e46876—12 pages (2012).
Cho, Chunghee, Testicular and epididymal ADAMS: expression and function during fertilization, Nat. Rev. Urol., 9:550-560 (2012).
Choi, H. et al., Identification and characterization of promoter and regulatory regions for mouse Adam2 gene expression, Mol Biol Rep, 40:787-796 (2013).
Choi, K. et al., Expression of the metabotropic glutamate receptor 5 (mGluR5) induces melanoma in transgenic mice, PNAS, 108(37):15219-15224 (2011).
Communication pursuant to Article 114(2) EPC, dated Jun. 21, 2013.
Declaration of Dr. Glenn Friedrich, 4 page (Mar. 3, 2016).
Declaration of E-Chiang Lee, Ph.D., 8 pages (Jun. 20, 2016).
Declaration of Hui Liu, Ph.D., 4 pages (Jun. 20, 2016).
Declaration of Meng (Amy) Li, Ph.D., 4 pages (Jun. 20, 2016).
Declaration of Prof. Allan Bradley, Ph.D., 37 pages (Jun. 20, 2016).
Declaration of Wei Wang, Ph.D., 8 pages (Jun. 20, 2016).
European Examination Report for EP 14154967.5, dated Sep. 9, 2014, 4 pages.
European Office Action for 12 716 101.6-1410, 5 pages, dated Jun. 17, 2014.
Extended European Search Report for 12192727.1, 8 pages (dated Mar. 7, 2013).
Extended European Search Report for 14154918.8, 8 pages (dated Aug. 27, 2014).
Extended European Search Report for 14176593.3, 10 pages (dated Nov. 19, 2014).
Glick, B. and Pasternak, J., Molekulyarnaya biotekhnologiya. Printsipy i primeneniye, Moscow Mir., 45-47 (2002).
Hoiruchi, K. and Blobel, C., Studies from Adam Knockout Mice, in Hooper and Lendeckel, The ADAM family of proteases, Netherlands 2005, Springer (37 pages).
International Search Report for PCT/US2012/026416, 4 pages (dated Jun. 25, 2012).
International Search Report for PCT/US2012/060487, 7 pages (dated Feb. 1, 2013).
Kong et al., Transgene expression is associated with copy number and cytomegalovirus promoter methylation in transgenic pigs, PLoS One 4(8):1-10 (2009).
Kuroiwa, Y. et al., Sequential targeting of the genes encoding immunoglobulin-µ and prion protein in cattle, Nature Genetics, 36:775-780 (2004).
Lee, E. et al., Complete humanization of the mouse immunoglobulin loci enables efficient therapeutic antibody discovery, Nature Biotechnology, 32:4:356, 12 pages (2014).
Lin, P. et al., Research of Immune Globulin in Mice, Guangzhou Medical Journal, 01:49-50 (1990).
Liu, Y. et al., Primary Genetic Investigation of a Hyperlipidemia Model: Molecular Characteristics and Variants of the Apolipoprotein E Gene in Mongolian Gerbil, Biomed Research International, 2014: 9 pages (2014).
Lovell-Badge, Robin, Many ways to pluripotency, Nature Biotechnology, 25:1114-1116 (2007).
Macdonald, L. et al., Velocigene Technology Extended to Humanization of Several Megabases of Complex Gene Loci, First International MUGEN Conference of Animal Models for Human Immunological Disease, Sep. 10-13, 2006—Athens, Greece, Abstract 21 and Poster, 2 pages (2006).
Manis, J. P. et al., Mechanism and control of Icass-switch recombination, Trends in immunology, 23:1:31-39 (2002).
Mar. 3, 2016 Letter from H. Van Der Hoff, Opposition against EP 2550363 (2 pages).
Mcgoldrick, P. et al., Roden models of amyotrophic lateral sclerosis, Biochimica et Biophysica Acta, 1832:1421-1436 (2013).
Murphy, L. and Silha, J., Unexpected and unexplained phenotypes in transgenic models, Growth Horm IGF Res., 10(5):233-235 (2000).
Nagle, Mike, Regeneron helps make Sanofi VelocImmune to its 'weak' pipeline, Breaking News on Contract Research, Manufacturing & Clinical Trials, 2 pages (2007).
Notice of Opposition to a European Patent for EP2550363, 28 pages (Dec. 10, 2014).
Office Action for U.S. Appl. No. 13/716,238, 7 pages (dated Jan. 4, 2016).
Office Action for U.S. Appl. No. 13/951,996, 7 pages (dated Dec. 17, 2015).
Office Action for U.S. Appl. No. 14/818,162, 30 pages (dated Dec. 11, 2015).
Opinion & Order between Regeneron Pharmaceuticals, Inc. and Merus B.V., 114 pages (Nov. 2, 2015).
Pasqualini, R. and Arap, W., Hybridoma-free generation of monoclonal antibodies, Proceedings of the National Academy of Sciences USA, 101(1):257-259 (2004).
Preliminary Opinion of Opposition Division on EP 2550363, 24 pages, Jul. 29, 2016.
Rudikoff, S. et al., Single amino acid substitution altering antigen-binding specificity, Immunology, 79:1979-1983 (1982).
Schulze, M. et al., Derivation, Maintenance, and Characterization of Rat Embryonic Stem Cells In Vitro, Methods in Molecular Biology, 329:45-58 (2006).
Shmerling et al., Strong and ubiquitous expression of transgenes targeted into the β-actin locus by Cre/lox cassette replacement, Genesis 42(5):229-235 (2005).
Sigmund, Curt D., Viewpoint: Are Studies in Genetically Altered Mice Out of Control?, Arterioscler Thromb Vasc Biol, 20(6):1425-1429 (2000).

(56) References Cited

OTHER PUBLICATIONS

Stevens, S. et al., Velocimmune: Humanization of Immunoglobulin Loc Using Velocigene Technology, First International MUGEN Conference of Animal Models for Human Immunological Disease, Sep. 10-13, 2006—Athens, Greece, Abstract 4 and Poster, 2 pages (2006).
Taki, S. et al., Targeted Insertion of a Variable Region Gene into the Immunoglobulin Heavy Chain Locus, Science, 262:1268-1271 (1993).
Third Party Observations on European Patent Application No. 12192727.1, 17 pages (Jun. 18, 2013).
Third Party Observations on European Patent Application No. 12192727.1, 3 pages (Feb. 25, 2014).
Third Party Observations on European Patent Application No. 12192727.1, 5 pages (Nov. 17, 2014).
Third Party Observations on European Patent Application No. 12192727.1, 7 pages (Apr. 8, 2015).
Third Party Observations on European Patent Application No. 12192727.1, 9 pages (Aug. 11, 2015).
Third Party Observations on European Patent Application No. 12716101.6, 4 pages (Feb. 25, 2014).
Third Party Observations on European Patent Application No. 12716101.6, 4 pages (Jul. 31, 2014).
Third Party Observations on European Patent Application No. 12716101.6, 4 pages (Sep. 4, 2013).
Third Party Observations on European Patent Application No. 12716101.6, 5 pages (Jun. 27, 2014).
Third Party Observations on European Patent Application No. 12809955.3, 3 pages (Aug. 6, 2015).
Third Party Observations on European Patent Application No. 12809955.3, 4 pages (Jun. 24, 2014).
Third Party Observations on European Patent Application No. 14154918.8, 5 pages (Nov. 26, 2014).
Third Party Observations on European Patent Application No. 14154918.8, 7 pages (Apr. 14, 2015).
Third Party Observations on European Patent Application No. 14154967.5, 5 pages (Nov. 18, 2014).
Third Party Observations on European Patent Application No. 14154967.5, 7 pages (Apr. 23, 2015).
Third Party Observations on European Patent Application Nos. 12192727.1, 14154918.8, 14154967.5, 14176593.3 and 12809955.3, 3 pages (Nov. 12, 2015).
Third Party Observations on U.S. Appl. No. 13/890,519, 27 pages (Oct. 23, 2013).
Written Opinion for PCT/US2012/026416 (8 pages), dated Jun. 25, 2012.
Written Opinion for PCT/US2012/060487, 5 pages (dated Feb. 1, 2013).
Yantha, J. et al., Unexpected Acceleration of Type 1 Diabetes by Transgenic Expression of B7-H1 in NOD Mouse Peri-Islet Glia, Diabetes, 59:2588-2596 (2010).
Zou, Y. et al., Cre-loxP-mediated gene replacement: a mouse strain producing humanized antibodies, Current Biology, 4:1099-1103 (1994).
Declaration of Dr. Jürgen Roes, Ph.D., 14 pages (Jul. 19, 2014).
Extended European Search Report with respect to EP 14754019.9 dated Aug. 28, 2015.
Johnston, C. et al., Complete Sequence Assembly and Characterization of the C57BL/6 Mouse Ig Heavy Chain V Region, J Immunol, 176:4221-4234 (2006).
Nishimura, H. et al., Possible Function of the ADAM1a/ADAM2 Fertilin Complex in the Appearance of ADAM3 on the Sperm Surface, The Journal of Biological Chemistry, 279(33):34957-34962 (2004).
Opponent Final Submissions for EP2550363, 15 pages (Jan. 27, 2017).
Osborn, M.J. et al., High-affinity IgG antibodies develop naturally in Ig-knockout rats carrying germline human IgH/Igκ/Igλ loci bearing the rat CH region, J Immunol, 190(4):1481-90 (2013).
Patentee Final Submissions for EP12716101.6, 4 pages (Jan. 27, 2017).
Response to Summons to attend Oral Proceedings for EP255036, 1 page (Feb. 28, 2017).
Second Declaration of Meng (Amy) Li, Ph.D., 14 pages (Sep. 15, 2016).
Tong, C. et al., Production of p53 gene knockout rats by homologous recombination in embryonic stem cells, Nature, 467(7312):211-3 (2010).
Written Opinion for PCT/US2014/026040 dated Jul. 29, 2014 (8 pages).
Interlocutory decision in Opposition proceedings (Art. 101(3)(a) and 106(2) EPC) for EP12716101.6, 36 pages (May 26, 2017).
Minutes of the taking of evidence by hearing of witnesses recorded in the oral proceedings before the Opposition Division for EP12716101.6, 25 pages (May 26, 2017).
Provision of the minutes in accordance with Rule 124(4) EPC for EP1276101.6, 62 pages (May 26, 2017).
Alfandari, D. et al., Xenopus ADAM 13 is a metalloprotease required for cranial neural crest-cell migration, Current Biology, 11:918-930 (2001).
Austin, C. et al., The Knockout Mouse Project, Nat. Genet., 36(9):921-924 (2004).
Blobel, Carl P., Adams: Key Components in EGFR Signalling and Development, Nature Reviews, Molecular Cell Biology, 6:32-43 (2005).
Borghei, A. et al., Targeted Disruption of Tyrosylprotein Sulfotransferase-2, an Enzyme That Catalyzes Post-translational Protein Tyrosine O-Sulfation, Causes Male Infertility, The Journal of Biological Chemistry, 281(14):9423-9431 (2006).
Cho, C. et al., Analysis of Mouse Fertilin in Wild-Type and Fertilin ß-/- Sperm: Evidence for C-terminal Modification, αl ß Dimerization, and Lack of Essential Role of Fertilin α in Sperm-Egg Fusion, Developmental Biology, 222:289-295 (2000).
Cho, C. et al., Fertilization Defects in Sperm from Mice Lacking Fertilin ß, Science, 281:1857-1859 (1998).
Cho, Chunghee, Mammalian ADAMS with Testis-Specific or -Predominant Expression, The ADAM Family of Proteases, 239-259 (2005).
Declaration of Dr. Kosuke Yusa and associated Annexes, 7 pages (Oct. 2, 2017).
Declaration of Dr. Liang in EP 2550363, 9 pages (Feb. 1, 2018).
Ensembl database entries for the heavy and light chain immunoglobulin loci, as submitted in EP 2550363 on Oct. 16, 2017, 3 pages.
Gaultier, A. et al., ADAM13 Disintegrin and Cysteine-rich Domains Bind to the Second Heparin-binding Domain of Fibronectin, The Journal of Biological Chemistry, 277(26):23336-23344 (2002).
Glassey, B. and Civetta, A., Positive Selection at Reproductive Adam Genes with Potential Intercellular Binding Activity, Molecular Biology and Evolution, 21(5):851-859 (2004).
Gorman, et al., The LGK 3' Enhancer Influences the Ratio of LGK Versus LGL B Lymphocytes, Immunity, 5(3): 241-252(1996).
Hagaman, J. et al., Angiotensin-covering enzyme and male fertility, Proc. Natl. Acad. Sci. USA, 95:2552-2557 (1998).
Han, C. et al., Impaired sperm aggregation in *Adam2* and *Adam3* null mice, Fertility and Sterility, 93(8):2754-2756 (2010).
Hoiruchi, K. and Blobel, C., Studies From ADAM Knockout Mice, The ADAM Family of Proteases, 29-64 (2005).
Huovila, A. et al., ADAMs and cell fusion, Current Opinion in Cell Biology, 8:692-699 (1996).
Ikawa, M. et al., Calsperin Is a Testis-specific Chaperone Required for Sperm Fertility, The Journal of Biological Chemistry, 286(7):5639-5646 (2011).
Immler, S. et al., By Hook or by Crook? Morphometry, Competition and Cooperation in Rodent Sperm, PLoS ONE, Issue 1(e170) 5 pages (2007).
Immler, Simone, Sperm competition and sperm cooperation: the potential role of diploid and haploid expression, Reproduction, 135:275-283 (2008).
International Search Report for PCT/US2011/041366, 5 pages (dated Sep. 22, 2011).
Kim, E. et al., Differential localization of ADAM1a and ADAM1b in the endoplasmic reticulum of testicular germ cells and on the surface of epididymal sperm, Biochemical and Biophysical Research Communications, 304:313-309 (2003).

(56) References Cited

OTHER PUBLICATIONS

Kim, E. et al., Mouse Sperm Lacking ADAM1b/ADAM2 Fertilin Can Fuse with the Egg Plasma Membrane and Effect Fertilization, The Journal of Biological Chemistry, 281(9):5634-5639 (2006).
Kim, E. et al., Synthesis, Processing, and Subcellular Localization of Mouse ADAM3 during Spermatogenesis and Epididymal Sperm Transport, Journal of Reproduction and Development, 50(5):571-578 (2004).
Krutskikh, A. et al., Epididymal protein Rnase10 is required for post-testicular sperm maturation and male fertility, The FASEB Journal, 26(10):4198-4209 (2012).
Linder, B. et al., Delayed Translation and Posttranslational Processing of Cyritestin, an Integral Transmembrane Protein of the Mouse Acrosome, Experimental Cell Research, 221:66-72 (1995).
Long, J. et al., Phylogenetic and molecular evolution of the Adam (A Disintegrin and Metalloprotease) gene family from Xenopus tropicalis, to Mus musculus, Rattus norvegicus, and *Homo sapiens*, Gene, 507:36-43 (2012).
Marcello, M. et al., Lack of Tyrosylprotein Sulfotransferase-2 Activity Results in Altered Sperm-Egg Interactions and Loss of ADAM3 and ADAM6 in Epididymal Sperm, The Journal of Biological Chemistry, 286(15):13060-13070 (2011).
Melton, David W., Chapter 8: Gene-Targeting Strategies, Methods in Molecular Biology, Transgenesis Techniques, 2nd Edition, Principles and Protocols, 180:19 pages (2002).
Moore, H. et al., Exceptional sperm cooperation in the wood mouse, Nature, 418:174-177 (2002).
Murphy, Andrew, Chapter 8: VelocImmune: Immunoglobulin Variable Region Humanized Mice, Recombinant Antibodies for Immunotherapy, Part III, 14 pages (2009).
Nakanishi, T. et al., Selective Passage Through the Uterotubal Junction of Sperm from a Mixed Population Produced by Chimeras of Calmegin-Knockout and Wild-Type Male Mice, Biology of Reproduction, 71:959-965 (2004).
Nishimura, H. et al., Analysis of Loss of Adhesive Function in Sperm Lacking Cyritestin or Fertilin ß, Developmental Biology, 233:204-213 (2001).
Nishimura, H. et al., Identification of an ADAM2-ADAM3 Complex on the Surface of Mouse Testicular Germ Cells and Cauda Epididymal Sperm, The Journal of Biological Chemistry, 282(24):17900-17907 (2007).
Pizzari, T. and Foster, K., Sperm Sociality: Cooperation, Altruism, and Spite, PLoS Biology, 6(5)(e130):0925-0931 (2008).
Popov, et al., A Human Immunoglobulin I locus is Similarly Well Expressed in Mice and Humans, J. Exp. Med., 189(10):1611-1619(1999).
Poueymirou, W. et al., F0 generation mice fully derived from gene-targeted embryonic stem cells allowing immediate phenotypic analyses, Nature Biotechnology, 25(1):91-99 (2007).
Primakoff, P. and Myles, D., The ADAM gene family: surface proteins with adhesion and protease activity, Trends Genet, 16(2):83-87 (2000).
Reply to Third Party Observations on EP2501817, (May 20, 2013).
Roebroek, A. et al., Chapter 10: Knockin Approaches, Methods in Molecular Biology, Transgenic Mouse Methods and Protocols, 209:16 pages (2003).
Roychaudhuri, R. et al., ADAM9 Is a Novel Product of Polymorphonuclear Neutrophils: Regulation of Expression and Contributions to Extracellular Matrix Protein Degradation during Acute Lung Injury, The Journal of Immunology, 193:2469-2482 (2014).
Schwartz, D. and Cantor, C., Separation of Yeast Chromosome-Sized DNAs by Pulsed Field Gradient Gel Electrophoresis, Cell, 37:67-75 (1984).
Shamsadin, R. et al., Male Mice Deficient for Germ-Cell Cyritestin Are Infertile, Biology of Reproduction, 61:1445-1451 (1999).
Sorrell, D. and Kolb, A., Chapter XI: Targeted Modification of Mammalian Genomes, Focus on Genome Research, 6 pages (2004).
Storb, U. et al., Transgenic Mice with µ and κ Genes Encoding Antiphosphorycholine Antibodies, J. Exp Med, 164:627-64 (1986).
Suarez, Susan S., Sperm Transport and Motility in the Mouse Oviduct: Observations in Situ, Biology of Reproduction, 36:203-210 (1987).
Swanson, W. and Vacquier, V., The Rapid Evolution of Reproductive Proteins, Nature Reviews, Genetics, 3:137-144 (2002).
Third Party Observations on EP2501817, (Feb. 28, 2013).
Tokuhiro, K. et al., Protein disulfide isomerase homolog PDILT is required for quality control of sperm membrane protein ADAM3 and male fertility, PNAS, 109(10):3850-3855 (2012).
Valenzuela, D. et al., High-throughput engineering of the mouse genome coupled with high-resolution expression analysis, Nature Biotechnology, 21(6):652-659 (2003).
White, Judith M., ADAMS: modulators of cell-cell and cell-matrix interactions, Current Opinion in Cell Biology, 15:598-606 (2003).
Wolfsberg, T. et al., ADAM, a Widely Distributed and Developmentally Regulated Gene Family Encoding Membrane Proteins with a Disintegrin and Metalloprotease Domain, Developmental Biology, 169:378-383 (1995).
Yamaguchi, R. et al., Aberrant Distribution of ADAM3 in Sperm from Both Angiotensin-Converting Enzyme (Ace)- and Calmegin (Clgn)-Deficient Mice, Biology of Reproduction, 75:760-766 (2006).
Yamaguchi, R. et al., Disruption of ADAM3 Impairs the Migration of Sperm into Oviduct in Mouse, Biology of Reproduction, 81:142-146 (2009).
Yamaguchi, R. et al., Mice expressing aberrant sperm-specific protein PMIS2 produce normal-looking but fertilization-incompetent spermatozoa, MBoC, 23:2671-2679 (2012).
Zhang, Y. et al., A new logic for DNA engineering using recombination in *Escherichia coli*, Nature Genetics, 20:123-128 (1998).
Zhu, G. et al., Testase 1 (ADAM 24) a plasma membrane-anchored sperm protease implicated in sperm function during epididymal maturation or fertilization, Journal of Cell Science, 114:1787-1794 (2001).

\* cited by examiner

```
            10         20         30         40         50         60         70
VH1-69*01  CAGGTgCAGCTGGTGCAGTCTGGGGCTGAGGTGAAGAAGCCTGGGTCCTCGGTGAAGGTCTCCTGCAAGGCTTCT
VH1-69*02  CAGGTCCAGCTGGTGCAaTCTGGGGCTGAGGTGAAGAAGCCTGGGTCCTCGGTGAAGGTCTCCTGCAAGGCTTCT
VH1-69*03  CAGGTgCAGCTGGTGCAGTCTGGGGCTGAGGTGAAGAAGCCTGGGTCCTCGGTGAAGGTCTCCTGCAAGGCTTCT
VH1-69*04  CAGGTCCAGCTGGTGCAGTCTGGGGCTGAGGTGAAGAAGCCTGGGTCCTCGGTGAAGGTCTCCTGCAAGGCTTCT
VH1-69*05  CAGGTCCAGCTGGTGCAGTCTGGGGCTGAGGTGAAGAAGCCTGGGTCCTCGGTGAAGGTCTCCTGCAAGGCTTCT
VH1-69*06  CAGGTgCAGCTGGTGCAGTCTGGGGCTGAGGTGAAGAAGCCTGGGTCCTCGGTGAAGGTCTCCTGCAAGGCTTCT
VH1-69*07  ------------------------------AGAAGCCTGGGTCCTCGGTGAAGGTCTCCTGCAAGGCTTCT
VH1-69*08  CAGGTCCAGCTGGTGCAaTCTGGGGCTGAGGTGAAGAAGCCTGGGTCCTCGGTGAAGGTCTCCTGCAAGGCTTCT
VH1-69*09  CAGGTgCAGCTGGTGCAGTCTGGGGCTGAGGTGAAGAAGCCTGGGTCCTCGGTGAAGGTCTCCTGCAAGGCTTCT
VH1-69*10  CAGGTCCAGCTGGTGCAGTCTGGGGCTGAGGTGAAGAAGCCTGGGTCCTCaGTGAAGGTCTCCTGCAAGGCTTCT
VH1-69*11  CAGGTCCAGCTGGTGCAGTCTGGGGCTGAGGTGAAGAAGCCTGGGTCCTCGGTGAAGGTCTCCTGCAAGGCTTCT
VH1-69*12  CAGGTCCAGCTGGTGCAGTCTGGGGCTGAGGTGAAGAAGCCTGGGTCCTCGGTGAAGGTCTCCTGCAAGGCTTCT
VH1-69*13  CAGGTCCAGCTGGTGCAGTCTGGGGCTGAGGTGAAGAAGCCTGGGTCCTCaGTGAAGGTCTCCTGCAAGGCTTCT
           CAGGTCCAGCTGGTGCAGTCTGGGGCTGAGGTGAAGAAGCCTGGGTCCTCGGTGAAGGTCTCCTGCAAGGCTTCT 80         90        100        110        120        130        140        150
VH1-69*01  GGAGGCACCTTCAGCAGCTATGCTATCAGCTGGGTGCGACAGGCCCCTGGACAAGGGCTTGAGTGGATGGGAGGG
VH1-69*02  GGAGGCACCTTCAGCAGCTATaCTATCAGCTGGGTGCGACAGGCCCCTGGACAAGGGCTTGAGTGGATGGGAaGG
VH1-69*03  GGAGGCACCTTCAGCAGCTATGCTATCAGCTGGGTGCGACAGGCCCCTGGACAAGGGCTTGAGTGGATGGGAGGG
VH1-69*04  GGAGGCACCTTCAGCAGCTATGCTATCAGCTGGGTGCGACAGGCCCCTGGACAAGGGCTTGAGTGGATGGGAaGG
VH1-69*05  GGAGGCACCTTCAGCAGCTATGCTATCAGCTGGGTGCGACAGGCCCCTGGACAAGGGCTTGAGTGGATGGGAGGG
VH1-69*06  GGAGGCACCTTCAGCAGCTATGCTATCAGCTGGGTGCGACAGGCCCCTGGACAAGGGCTTGAGTGGATGGGAGGG
VH1-69*07  GGAGGCACCTTCAGCAGCTATGCTATCAGCTGGGTGCGACAGGCCCCTGGACAAGGGCTTGAGTGGATGGGAaGG
VH1-69*08  GGAGGCACCTTCAGCAGCTATaCTATCAGCTGGGTGCGACAGGCCCCTGGACAAGGGCTTGAGTGGATGGGAaGG
VH1-69*09  GGAGGCACCTTCAGCAGCTATGCTATCAGCTGGGTGCGACAGGCCCCTGGACAAGGGCTTGAGTGGATGGGAGGG
VH1-69*10  GGAGGCACCTTCAGCAGCTATGCTATCAGCTGGGTGCGACAGGCCCCTGGACAAGGGCTTGAGTGGATGGGAaGG
VH1-69*11  GGAGGCACCTTCAGCAGCTATGCTATCAGCTGGGTGCGACAGGCCCCTGGACAAGGGCTTGAGTGGATGGGAaGG
VH1-69*12  GGAGGCACCTTCAGCAGCTATGCTATCAGCTGGGTGCGACAGGCCCCTGGACAAGGGCTTGAGTGGATGGGAGGG
VH1-69*13  GGAGGCACCTTCAGCAGCTATGCTATCAGCTGGGTGCGACAGGCCCCTGGACAAGGGCTTGAGTGGATGGGAGGG
           GGAGGCACCTTCAGCAGCTATGCTATCAGCTGGGTGCGACAGGCCCCTGGACAAGGGCTTGAGTGGATGGGAGGG 160        170        180        190        200        210        220
VH1-69*01  ATCATCCCTATCTTTGGTACAGCAAACTACGCACAGAAGTTCCAGGGCAGAGTCACGATTACCGCGGACGAATCC
VH1-69*02  ATCATCCCTATCcTTGGTAtAGCAAACTACGCACAGAAGTTCCAGGGCAGAGTCACGATTACCGCGGACaAATCC
VH1-69*03  ATCATCCCTATCTTTGGTACAGCAAACTACGCACAGAAGTTCCAGGGCAGAGTCACGATTACCGCGGACGAATCC
VH1-69*04  ATCATCCCTATCcTTGGTAtAGCAAACTACGCACAGAAGTTCCAGGGCAGAGTCACGATTACCGCGGACaAATCC
VH1-69*05  ATCATCCCTATCTTTGGTACAGCAAACTACGCACAGAAGTTCCAGGGCAGAGTCACGATTACcaCGGACGAATCC
VH1-69*06  ATCATCCCTATCTTTGGTACAGCAAACTACGCACAGAAGTTCCAGGGCAGAGTCACGATTACCGCGGACaAATCC
VH1-69*07  ATCATCCCTATCTTTGGTACAGCAAACTACGCACAGAAGTTCCAGGGCAGAGTCACGATTACCGCGGACGAATCC
VH1-69*08  ATCATCCCTATCcTTGGTACAGCAAACTACGCACAGAAGTTCCAGGGCAGAGTCACGATTACCGCGGACaAATCC
VH1-69*09  ATCATCCCTATCcTTGGTAtAGCAAACTACGCACAGAAGTTCCAGGGCAGAGTCACGATTACCGCGGACaAATCC
VH1-69*10  ATCATCCCTATCcTTGGTAtAGCAAACTACGCACAGAAGTTCCAGGGCAGAGTCACGATTACCGCGGACaAATCC
VH1-69*11  ATCATCCCTATCcTTGGTACAGCAAACTACGCACAGAAGTTCCAGGGCAGAGTCACGATTACCGCGGACGAATCC
VH1-69*12  ATCATCCCTATCTTTGGTACAGCAAACTACGCACAGAAGTTCCAGGGCAGAGTCACGATTACCGCGGACGAATCC
VH1-69*13  ATCATCCCTATCTTTGGTACAGCAAACTACGCACAGAAGTTCCAGGGCAGAGTCACGATTACCGCGGACGAATCC
           ATCATCCCTATCTTTGGTACAGCAAACTACGCACAGAAGTTCCAGGGCAGAGTCACGATTACCGCGGACGAATCC 230        240        250        260        270        280        290
VH1-69*01  ACGAGCACAGCCTACATGGAGCTGAGCAGCCTGAGATCTGAGGACACGGCCGTGTATTACTGTGCGAGAGAA
VH1-69*02  ACGAGCACAGCCTACATGGAGCTGAGCAGCCTGAGATCTGAGGACACGGCCGTGTATTACTGTGCGAGA---
VH1-69*03  ACGAGCACAGCCTACATGGAGCTGAGCAGCCTGAGATCTGAtGACACGGC-----------------
VH1-69*04  ACGAGCACAGCCTACATGGAGCTGAGCAGCCTGAGATCTGAGGACACGGCCGTGTATTACTGTGCGAGAGAA
VH1-69*05  ACGAGCACAGCCTACATGGAGCTGAGCAGCCTGAGATCTGAGGACACGGCCGTGTATTACTGTGCGAGA---
VH1-69*06  ACGAGCACAGCCTACATGGAGCTGAGCAGCCTGAGATCTGAGGACACGGCCGTGTATTACTGTGCGAGAGAA
VH1-69*07  ACGAGCACAGCCTACATGGAGCTGAGCAGCCTGAGATCTGAG-------------------
VH1-69*08  ACGAGCACAGCCTACATGGAGCTGAGCAGCCTGAGATCTGAGGACACGGCCGTGTATTACTGTGCGAGAGAA
VH1-69*09  ACGAGCACAGCCTACATGGAGCTGAGCAGCCTGAGATCTGAGGACACGGCCGTGTATTACTGTGCGAGAGAA
VH1-69*10  ACGAGCACAGCCTACATGGAGCTGAGCAGCCTGAGATCTGAGGACACGGCCGTGTATTACTGTGCGAGAGAA
VH1-69*11  ACGAGCACAGCCTACATGGAGCTGAGCAGCCTGAGATCTGAGGACACGGCCGTGTATTACTGTGCGAGAGAA
VH1-69*12  ACGAGCACAGCCTACATGGAGCTGAGCAGCCTGAGATCTGAGGACACGGCCGTGTATTACTGTGCGAGAGAA
VH1-69*13  ACGAGCACAGCCTACATGGAGCTGAGCAGCCTGAGATCTGAGGACACGGCCGTGTATTACTGTGCGAGAGAA
           ACGAGCACAGCCTACATGGAGCTGAGCAGCCTGAGATCTGAGGACACGGCCGTGTATTACTGTGCGAGAGA
```

FIG. 5

|          |    |    |    |    |    |    |
|----------|----|----|----|----|----|----|
|          | 10 | 20 | 30 | 40 | 50 | 60 |
| VH1-69*01 | QVQLVQSGAEVKKPGSSVKVSCKASGGTFSSYA | ISWVRQAPGQGLEWMGG | IIPIFGTANY |
| VH1-69*02 | QVQLVQSGAEVKKPGSSVKVSCKASGGTFSSYA | ISWVRQAPGQGLEWMGr | IIPIlGTANY |
| VH1-69*03 | QVQLVQSGAEVKKPGSSVKVSCKASGGTFSSYA | ISWVRQAPGQGLEWMGr | IIPIlGiANY |
| VH1-69*04 | QVQLVQSGAEVKKPGSSVKVSCKASGGTFSSYA | ISWVRQAPGQGLEWMGr | IIPIlGTANY |
| VH1-69*05 | QVQLVQSGAEVKKPGSSVKVSCKASGGTFSSYA | ISWVRQAPGQGLEWMGr | IIPIlGTANY |
| VH1-69*06 | QVQLVQSGAEVKKPGSSVKVSCKASGGTFSSYA | ISWVRQAPGQGLEWMGG | IIPIFGTANY |
| VH1-69*07 | ------KPGSSVKVSCKASGGTFSSYt | ISWVRQAPGQGLEWMGr | IIPIlGiANY |
| VH1-69*08 | QVQLVQSGAEVKKPGSSVKVSCKASGGTFSSYA | ISWVRQAPGQGLEWMGr | IIPIlGiANY |
| VH1-69*09 | QVQLVQSGAEVKKPGSSVKVSCKASGGTFSSYA | ISWVRQAPGQGLEWMGr | IIPIlGTANY |
| VH1-69*10 | QVQLVQSGAEVKKPGSSVKVSCKASGGTFSSYA | ISWVRQAPGQGLEWMGr | IIPIlGiANY |
| VH1-69*11 | QVQLVQSGAEVKKPGSSVKVSCKASGGTFSSYt | ISWVRQAPGQGLEWMGG | IIPIFGTANY |
| VH1-69*12 | QVQLVQSGAEVKKPGSSVKVSCKASGGTFSSYA | ISWVRQAPGQGLEWMGG | IIPIFGTANY |
| VH1-69*13 | QVQLVQSGAEVKKPGSSVKVSCKASGGTFSSYA | ISWVRQAPGQGLEWMGG | IIPIFGTANY |

|           | 70 | 80 | 90 | 100 |
|-----------|----|----|----|-----|
| VH1-69*01 | AQKFQGRVTITADESTSTAYMELSSLRSEDTAVYYC | ARR |
| VH1-69*02 | AQKFQGRVTITADKSTSTAYMELSSLRSEDTAVYYC | ARR |
| VH1-69*03 | AQKFQGRVTITADKSTSTAYMELSSLRSEDTAVYYC | ARR |
| VH1-69*04 | AQKFQGRVTITADKSTSTAYMELSSLRSDDT----- | CARR |
| VH1-69*05 | AQKFQGRVTITtDESTSTAYMELSSLRSEDTAVYYC | ARR |
| VH1-69*06 | AQKFQGRVTITADKSTSTAYMELSSLRSEDTAVYYC | ARR |
| VH1-69*07 | AQKFQGRVTITADKSTSTAYMELSSLRSEDTAVYYC | ARR |
| VH1-69*08 | AQKFQGRVTITADESTSTAYMELSSLRSE------- | CARR |
| VH1-69*09 | AQKFQGRVTITADKSTSTAYMELSSLRSEDTAVYYC | ARR |
| VH1-69*10 | AQKFQGRVTITADESTSTAYMELSSLRSEDTAVYYC | ARR |
| VH1-69*11 | AQKFQGRVTITADESTSTAYMELSSLRSEDTAVYYC | ARR |
| VH1-69*12 | AQKFQGRVTITADESTSTAYMELSSLRSEDTAVYYC | ARR |
| VH1-69*13 | AQKFQGRVTITADESTSTAYMELSSLRSEDTAVYYC | AR |

FIG. 6

| VH1-69 Allele | VH1-69*01 | VH1-69*02 | VH1-69*03 | VH1-69*04 | VH1-69*05 | VH1-69*06 | VH1-69*07 | VH1-69*08 | VH1-69*09 | VH1-69*10 | VH1-69*11 | VH1-69*12 | VH1-69*13 |
|---|---|---|---|---|---|---|---|---|---|---|---|---|---|
| VH1-69*01 | 100 | 94.9 | 91.8 | 95.9 | 99 | 99 | 77.6 | 95.9 | 95.9 | 96.9 | 98 | 100 | 100 |
| VH1-69*02 | 95.9 | 100 | 86.7 | 99 | 93.9 | 95.9 | 74.5 | 99 | 99 | 98 | 96.9 | 94.9 | 94.9 |
| VH1-69*03 | 92.9 | 88.8 | 100 | 87.8 | 90.8 | 90.8 | 82.4 | 87.8 | 87.8 | 88.8 | 89.8 | 91.8 | 91.8 |
| VH1-69*04 | 95.9 | 100 | 88.8 | 100 | 94.9 | 96.9 | 75.5 | 98 | 100 | 99 | 98 | 95.9 | 95.9 |
| VH1-69*05 | 100 | 95.9 | 92.9 | 95.9 | 100 | 98 | 76.5 | 94.9 | 94.9 | 95.9 | 96.9 | 99 | 99 |
| VH1-69*06 | 99.0 | 96.9 | 91.8 | 96.9 | 99 | 100 | 76.5 | 96.9 | 96.9 | 98 | 96.9 | 99 | 99 |
| VH1-69*07 | 77.6 | 75.5 | 83.5 | 75.5 | 77.6 | 76.5 | 100 | 75.5 | 75.5 | 74.5 | 77.6 | 77.6 | 77.6 |
| VH1-69*08 | 96.9 | 99 | 89.8 | 99 | 96.9 | 98 | 76.5 | 100 | 98 | 96.9 | 98 | 95.9 | 95.9 |
| VH1-69*09 | 95.9 | 100 | 88.8 | 100 | 95.9 | 96.9 | 75.5 | 99 | 100 | 99 | 98 | 95.9 | 95.9 |
| VH1-69*10 | 96.9 | 99 | 89.8 | 99 | 96.9 | 98 | 74.5 | 96.9 | 99 | 100 | 96.9 | 96.9 | 96.9 |
| VH1-69*11 | 98 | 98 | 90.8 | 98 | 98 | 96.9 | 77.6 | 98 | 98 | 96.9 | 100 | 98 | 98 |
| VH1-69*12 | 100 | 95.9 | 92.9 | 95.9 | 100 | 99 | 77.6 | 96.9 | 95.9 | 96.9 | 98 | 100 | 100 |
| VH1-69*13 | 100 | 95.9 | 92.9 | 95.9 | 100 | 99 | 77.6 | 96.9 | 95.9 | 96.9 | 98 | 100 | 100 |

% IDENTITY (upper triangle) / % SIMILARITY (lower triangle)

|          | 1          10         20          30         40         50 |
|----------|----------------------------------------------------------------|
| VH1-2*01 | QVQLVQSGAEVKKPGASVKVSCKAS GYTFTGYYMH WVRQAPGQGLEWMGr |
| VH1-2*02 | QVQLVQSGAEVKKPGASVKVSCKAS GYTFTGYYMH WVRQAPGQGLEWMGW |
| VH1-2*03 | QVQLVQSGAEVKKlGASVKVSCKAS GYTFTGYYMH WVRQAPGQGLEWMGW |
| VH1-2*04 | QVQLVQSGAEVKKPGASVKVSCKAS GYTFTGYYMHV xQAPGQGLEWMGW |
| VH1-2*05 | QVQLVQSGAEVKKPGASVKVSCKAS GYTFTGYYMH WVRQAPGQGLEWMGr |
|          | QVQLVQSGAEVKKPGASVKVSCKAS GYTFTGYYMH WVRQAPGQGLEWMGW |

|          | 60         70         80         90 |
|----------|--------------------------------------|
| VH1-2*01 | INPNSGGT NYAQKFQGRVTsTRDTSISTAYMELSRLRSDDTVVYYCAR |
| VH1-2*02 | INPNSGGT NYAQKFQGRVTMTRDTSISTAYMELSRLRSDDTAVYYCAR |
| VH1-2*03 | INPNSGGT NYAQKFQGRVTMTRDTSISTAYMELSRLRSDDTAVYYCAR |
| VH1-2*04 | INPNSGGT NYAQKFQGwVTMTRDTSISTAYMELSRLRSDDTVVYYCAR |
| VH1-2*05 | INPNSGGT NYAQKFQGRVTMTRDTSISTAYMELSRLRSDDTAVYYCAR |
|          | INPNSGGT NYAQKFQGRVTMTRDTSISTAYMELSRLRSDDTAVYYCAR |

FIG. 9

| V$_H$1-2 Allele | V$_H$1-2*01 | V$_H$1-2*02 | V$_H$1-2*03 | V$_H$1-2*04 | V$_H$1-2*05 |
|---|---|---|---|---|---|
| V$_H$1-2*01 | 100 | 96.9 | 94.9 | 95.9 | 99.0 |
| V$_H$1-2*02 | 96.9 | 100 | 98.0 | 99.0 | 98.0 |
| V$_H$1-2*03 | 94.9 | 98.0 | 100 | 96.9 | 95.9 |
| V$_H$1-2*04 | 95.9 | 99.0 | 96.9 | 100 | 96.9 |
| V$_H$1-2*05 | 99.0 | 98.0 | 95.9 | 96.9 | 100 |

% IDENTITY / % SIMILARITY

FIG. 10

HUMANIZED NON-HUMAN ANIMALS WITH RESTRICTED IMMUNOGLOBULIN HEAVY CHAIN LOCI

CROSS-REFERENCE TO RELATED APPLICATIONS

This application claims the benefit under 35 USC § 119(e) of U.S. Provisional Patent Application No. 61/658,466, filed 12 Jun. 2012, and U.S. Provisional Patent Application No. 61/663,131, filed 22 Jun. 2012; both applications are hereby incorporated by reference in their entirety.

FIELD

Genetically engineered non-human animals that comprise a reduced immunoglobulin heavy chain variable gene complexity are provided, wherein the non-human animals are capable of expressing an ADAM6 protein or functional fragment thereof. Genetically engineered non-human animals that express antibodies from a restricted number of immunoglobulin heavy chain variable gene segments and/or variants thereof, wherein the non-human animals lack a functional endogenous ADAM6 gene but retain ADAM6 function, are described, including mice that comprise a modification of an endogenous immunoglobulin heavy chain variable ($V_H$) region locus that renders the mouse incapable of making a functional ADAM6 protein and results in a loss in fertility. The genetically modified mice comprise an immunoglobulin $V_H$ locus characterized by a restricted number of $V_H$ gene segments, e.g., a single immunoglobulin $V_H$ segment, e.g., a human $V_H$1-69 gene segment or a human $V_H$1-2 gene segment, and that further comprise ADAM6 function are described, including mice that comprise an ectopic nucleic acid sequence that restores fertility to a male mouse.

Genetically modified mice, cells, embryos, and tissues that comprise a nucleic acid sequence encoding a functional ADAM6 locus are described, wherein the mice, cells, embryos, and tissues express an immunoglobulin heavy chain derived from a single human $V_H$ gene segment. Further, the mice, cells, embryos, and tissues lack a functional endogenous ADAM6 gene but retain ADAM6 function characterized by the presence of an ectopic nucleic acid sequence that encodes an ADAM6 protein. Methods for making antibody sequences in fertile non-human animals that are useful for binding pathogens, including human pathogens are provided.

BACKGROUND

Non-human animals, e.g., mice, have been genetically engineered to be useful tools in methods for making antibody sequences for use in antibody-based human therapeutics. Mice with humanized variable region loci (e.g., $V_H$, $D_H$, and $J_H$ genes, and $V_L$ and $J_L$ genes) are used to generate cognate heavy and light chain variable domains for use in antibody therapeutics. Mice that generate fully human antibodies with cognate heavy and light chains are known in the art. For the creation of these mice, it was necessary to disable the endogenous mouse immunoglobulin genes so that the randomly integrated fully human transgenes would function as the expressed repertoire of immunoglobulins in the mouse. Such mice can make human antibodies suitable for use as human therapeutics, but these mice display substantial problems with their immune systems. These problems lead to several experimental hurdles, for example, the mice are impractical for generating sufficiently diverse antibody repertoires, require the use of extensive re-engineering fixes, provide a suboptimal clonal selection process likely due to incompatibility between human and mouse elements, and an unreliable source of large and diverse populations of human variable sequences needed to be truly useful for making human therapeutics.

Human antibody therapeutics are engineered based on desired characteristics with respect to selected antigens. Humanized mice are immunized with the selected antigens, and the immunized mice are used to generate antibody populations from which to identify high-affinity cognate heavy and light variable domains with desired binding characteristics. Some humanized mice, such as those having a humanization of just variable regions at endogenous mouse loci, generate populations of B cells that are similar in character and number to wild-type mouse B cell populations. As a result, an extremely large and diverse population of B cells is available in these mice from which to screen antibodies, reflecting a large number of different immunoglobulin rearrangements, to identify heavy and light variable domains with the most desirable characteristics.

However, not all antigens provoke an immune response that exhibits a very large number of rearrangements from a wide selection of variable (V) segments. That is, the human humoral immune response to certain antigens is apparently restricted. The restriction is reflected in clonal selection of B cells that express only certain V segments that bind that particular antigen with sufficiently high affinity and specificity. Some such antigens are clinically significant, i.e., a number are well-known human pathogens. A presumption arises that the V segment expressed in the human immune response is a V segment that, in combination with a human D and a human J segment, is more likely to generate a useful high affinity antibody than a randomly selected V segment that has not been observed in a human antibody response to that antigen.

It is hypothesized that natural selection, over millennia of experience between humans and the pathogen, has selected the most efficient foundation or base from which to design its most effective weapon for neutralizing the pathogen—the selected V gene segment. There is a need in the art for superior antibodies that bind and/or neutralize antigens like the pathogens discussed above. There is a need to more rapidly generate useful sequences from selected V gene segments, including polymorphic and/or somatically mutated selected V gene segments and to more rapidly generate useful populations of B cells having rearrangements of the V gene segments with various D and J gene segments, including somatically mutated versions thereof, and in particular rearrangements with unique and useful CDR3 regions. There is a need for improved biological systems, e.g., non-human animals (such as, e.g., mice, rats, rabbits, etc.) that can generate therapeutically useful antibody variable region sequences from selected V gene segments in increased number and diversity that, e.g., can be achieved in existing modified animals, while at the same time reducing or eliminating deleterious changes that might result from the genetic modifications. There is a need for improved biological systems engineered to have a committed humoral immune system for clonally selecting antibody variable sequences derived from restricted, selected V gene segments, including but not limited to cognate human heavy and light chain variable domains, useful in the manufacture of human antibody-based therapeutics against selected antigens, including certain human pathogens. There remains a need in the art for making improved genetically modified mice that are useful in generating immunoglobulin sequences, including human antibody sequences, directed to the elimination of pathogens that burden the human population.

There is a need in the art for therapeutic antibodies that are capable of neutralizing viral antigens, e.g., HIV and HCV, including antigen-specific antibodies containing heavy chains derived from a single human variable gene segment. There is also a need for further methods and non-human animals for making useful antibodies, including antibodies that comprise a repertoire of heavy chains derived from a single human $V_H$ segment and having a diverse set of CDR sequences including heavy chains that express with cognate human light chains, and including restoration of unfavorable effects resulting from insertion of human genomic sequences into the genome of the non-human animals. Methods are needed for selecting CDRs for immunoglobulin-based binding proteins that provide an enhanced diversity of binding proteins from which to choose, and enhanced diversity of immunoglobulin variable domains, including compositions and methods for generating somatically mutated and clonally selected immunoglobulin variable domains for use, e.g., in making human therapeutics.

SUMMARY

Genetically modified immunoglobulin loci are provided that comprise a restricted number of different heavy chain variable region gene segments (i.e., V genes, $V_H$ genes, $V_H$ gene segments, or V gene segments), e.g., no more than one, two, or three different V genes; or no more than one V gene segment family member present, e.g., in a single copy or in multiple copies and/or comprising one or more polymorphisms, and in various embodiments the loci lack a sequence that encodes an endogenous functional ADAM6 protein.

Loci are provided that are capable of rearranging and forming a gene encoding a heavy chain variable domain that is derived from a heavy chain V gene repertoire that is restricted, e.g., that is a single $V_H$ gene segment or selected from a plurality of polymorphic variants of the single $V_H$ gene segment, wherein in various embodiments the loci lack an endogenous functional ADAM6 gene or functional fragment thereof.

Modified immunoglobulin loci include loci that lack an endogenous functional ADAM6 gene and comprise human immunoglobulin sequences are provided, e.g., a human V segment operably linked to a human or (or human/non-human chimeric) non-human immunoglobulin constant sequence (and in operable linkage with, e.g., a D and/or a J segment). Modified loci that comprise multiple copies of a single $V_H$ gene segment, including wherein one or more of the copies comprises a polymorphic variant, and an ectopic nucleotide sequence that encodes an ADAM6 protein or fragment thereof that is functional in the non-human animal, are provided. Modified loci that comprise multiple copies of a single $V_H$ segment, operably linked with one or more D segments and one or more J segments, operably linked to a non-human immunoglobulin constant sequence, e.g., a mouse or rat or human sequence, are provided. Non-human animals comprising such humanized loci are also provided, wherein the non-human animals have wild-type fertility.

Non-human animals are provided that comprise an immunoglobulin heavy chain variable locus (e.g., one a transgene or as an insertion or replacement at an endogenous non-human animal heavy chain variable locus) that comprises a single $V_H$ segment operably linked to a D and/or J gene segment. In various embodiments, the single $V_H$ gene segment is operably linked to one or more D and/or one or more J gene segments at the endogenous immunoglobulin heavy chain variable gene locus of the non-human animal. In various embodiments, the non-human animals further comprise an ectopic nucleotide sequence that encodes an ADAM6 protein or homolog or ortholog thereof that is functional in the male non-human animal that comprises the modified heavy chain locus. In various embodiments, the ectopic nucleotide sequence is contiguous with the single $V_H$ segment, a D gene segment, or a J gene segment. In various embodiments, the ectopic nucleotide sequence is contiguous with a non-immunoglobulin sequence in the genome of the non-human animal. In one embodiment, the ectopic nucleotide sequence is on the same chromosome as the modified heavy chain locus. In one embodiment, the ectopic nucleotide sequence is on a different chromosome as the modified heavy chain locus.

Non-human animals are provided that are modified at their immunoglobulin heavy chain variable region loci to delete all or substantially all (e.g., all functional segments, or nearly all functional segments) endogenous immunoglobulin $V_H$ segments and that comprise a human $V_H$1-69 segment (or a human $V_H$1-2 segment) operably linked to a D and J segment or a J segment at the endogenous immunoglobulin heavy chain variable region locus of the non-human animal. Non-human animals comprising such loci and that lack an endogenous ADAM6 gene(s) are also provided.

Methods are provided for making human immunoglobulin sequences in non-human animals. In various embodiments the human immunoglobulin sequences are derived from a repertoire of immunoglobulin V sequences that consist essentially of a single human V segment, e.g., $V_H$1-69 or $V_H$1-2, and one or more D and J segments or one or more J segments. Methods for making human immunoglobulin sequences in non-human animals, tissues, and cells are provided, wherein the human immunoglobulin sequences bind a pathogen.

In one aspect, nucleic acid constructs, cells, embryos, mice, and methods are provided for making mice that comprise a modification that results in a nonfunctional endogenous mouse ADAM6 protein or ADAM6 gene (e.g., a knockout of or a deletion in an endogenous ADAM6 gene), wherein the mice comprise a nucleic acid sequence that encodes an ADAM6 protein or ortholog or homolog or fragment thereof that is functional in a male mouse. In one embodiment, the mice comprise an ectopic nucleotide sequence encoding a rodent ADAM6 protein or ortholog or homolog or functional fragment thereof; in a specific embodiment, the rodent ADAM6 protein is a mouse ADAM6 protein.

In one aspect, nucleic acid constructs, cells, embryos, mice, and methods are provided for making mice that comprise a modification of an endogenous mouse immunoglobulin locus, wherein the mice comprise an ADAM6 protein or ortholog or homolog or fragment thereof that is functional in a male mouse. In one embodiment, the endogenous mouse immunoglobulin locus is an immunoglobulin heavy chain locus, and the modification reduces or eliminates ADAM6 activity of a cell or tissue of a male mouse. In one embodiment, the endogenous mouse immunoglobulin locus is an immunoglobulin heavy chain locus, and the modification maintains or sustains ADAM6 activity of a cell or tissue of a male mouse.

In one aspect, a modified immunoglobulin heavy chain locus is provided that comprises a heavy chain V segment repertoire that is restricted with respect to the identity of the V segment, and that comprises one or more D segments and one or more J segments, or one or more J segments. In one embodiment, the heavy chain V segment is a human segment. In one embodiment, the modified immunoglobulin heavy chain locus lacks an endogenous ADAM6 gene. In one embodiment, the modified heavy chain locus further comprises a nucleotide sequence that encodes an ADAM6 protein. In a specific embodiment, the nucleotide sequence is contiguous with the V, D and/or J gene segment at the modified immunoglobulin heavy chain locus.

In one embodiment, the modified locus is a non-human locus. In one embodiment, the non-human locus is modified with at least one human immunoglobulin sequence. In one embodiment, the non-human locus is modified with at least one human immunoglobulin sequence and a sequence that encodes an ADAM6 protein.

In one embodiment, the restriction is to one V segment family member. In one embodiment, the one V segment family member is present in two or more copies. In one embodiment, the one V segment family member is present as two or more variants (e.g., two or more polymorphic forms of the V segment family member). In one embodiment, the one V segment is a human V segment family member. In one embodiment, the one V segment family member is present in a number of variants as is observed in the human population with respect to that variant. In one embodiment, the V segment family member is selected from Table 1. In one embodiment, the V segment family member is present in a number of variants as shown, for each V segment, in a number of alleles from 1 allele to the number of alleles shown in the right column of Table 1.

In one aspect, mice are provided that comprise an ectopic nucleotide sequence encoding a mouse ADAM6 or ortholog or homolog or functional fragment thereof; mice are also provided that comprise an endogenous nucleotide sequence encoding a mouse ADAM6 or ortholog or homolog or fragment thereof, and at least one genetic modification of a heavy chain immunoglobulin locus. In one embodiment, the endogenous nucleotide sequence encoding a mouse ADAM6 or ortholog or homolog or fragment thereof is located at an ectopic position as compared to an endogenous ADAM6 gene of a wild type mouse.

In one aspect, methods are provided for making mice that comprise a modification of an endogenous mouse immunoglobulin locus, wherein the mice comprise an ADAM6 protein or ortholog or homolog or fragment thereof that is functional in a male mouse.

In one aspect, methods are provided for making mice that comprise a genetic modification of an immunoglobulin heavy chain locus, wherein application of the methods result in male mice that comprise a modified immunoglobulin heavy chain locus (or a deletion thereof), and the male mice are capable of generating offspring by mating. In one embodiment, the male mice are capable of producing sperm that can transit from a mouse uterus through a mouse oviduct to fertilize a mouse egg.

In one aspect, methods are provided for making mice that comprise a genetic modification of an immunoglobulin heavy chain locus, wherein application of the methods result in male mice that comprise a modified immunoglobulin heavy chain locus (or a deletion thereof), and the male mice exhibit a reduction in fertility, and the mice comprise a genetic modification that restores in whole or in part the reduction in fertility. In various embodiments, the reduction in fertility is characterized by an inability of the sperm of the male mice to migrate from a mouse uterus through a mouse oviduct to fertilize a mouse egg. In various embodiments, the reduction in fertility is characterized by sperm that exhibit an in vivo migration defect. In various embodiments, the genetic modification that restores in whole or in part the reduction in fertility is a nucleic acid sequence encoding a mouse ADAM6 gene or ortholog or homolog or fragment thereof that is functional in a male mouse.

In one embodiment, the genetic modification comprises replacing endogenous immunoglobulin heavy chain variable loci with a restricted number, e.g., no more than one, two or three different heavy chain variable ($V_H$) gene segments, one or more heavy chain diversity ($D_H$) gene segments and one or more heavy chain joining ($J_H$) gene segments of another species (e.g., a non-mouse species). In one embodiment, the genetic modification comprises insertion of a single orthologous immunoglobulin $V_H$ gene segment, at least one $D_H$ gene segment, and at least one $J_H$ gene segment into endogenous immunoglobulin heavy chain variable loci. In a specific embodiment, the species is human. In one embodiment, the genetic modification comprises deletion of an endogenous immunoglobulin heavy chain variable locus in whole or in part, wherein the deletion results in a loss of endogenous ADAM6 function. In a specific embodiment, the loss of endogenous ADAM6 function is associated with a reduction in fertility in male mice. In one embodiment, the genetic modification comprises inactivation of an endogenous immunoglobulin heavy chain variable locus in whole or in part, wherein the deletion does not result in a loss of endogenous ADAM6 function. Inactivation may include replacement or deletion of one or more endogenous gene segments resulting in an endogenous immunoglobulin heavy chain locus that is substantially incapable of rearrangement to encode a heavy chain of an antibody that comprises endogenous gene segments. Inactivation may include other modifications that render the endogenous immunoglobulin heavy chain locus incapable of rearranging to encode the heavy chain of an antibody, wherein the modification does not include replacement or deletion of endogenous gene segments. Exemplary modifications include chromosomal inversions and/or translocations mediated by molecular techniques, e.g., using precise placement of site-specific recombination sites (e.g., Cre-lox technology).

In one embodiment, the genetic modification comprises inserting into the genome of the mouse a DNA fragment containing a restricted number, e.g., no more than one, two or three different heavy chain variable ($V_H$) gene segments, one or more heavy chain diversity ($D_H$) gene segments and one or more heavy chain joining ($J_H$) gene segments of another species (e.g., a non-mouse species) operably linked to one or more constant region sequences (e.g., an IgM and/or an IgG gene). In one embodiment, the DNA fragment is capable of undergoing rearrangement to form a sequence that encodes a heavy chain of an antibody. In one embodiment, the genetic modification comprises insertion of a single orthologous immunoglobulin $V_H$ gene segment, at least one $D_H$ gene segment, and at least one $J_H$ gene segment into the genome of the mouse. In a specific embodiment, the species is human. In one embodiment, the genetic modification comprises deletion of an endogenous immunoglobulin heavy chain variable locus in whole or in part to render the endogenous immunoglobulin heavy chain locus nonfunctional, wherein the deletion further results in a loss of endogenous ADAM6 function. In a specific embodiment, the loss of endogenous ADAM6 function is associated with a reduction in fertility in male mice.

In one aspect, mice are provided that comprise a modification that reduces or eliminates mouse ADAM6 expression from an endogenous ADAM6 allele such that a male mouse having the modification exhibits a reduced fertility (e.g., a highly reduced ability to generate offspring by mating), or is essentially infertile, due to the reduction or elimination of endogenous ADAM6 function, wherein the mice further comprise an ectopic ADAM6 sequence or homolog or ortholog or functional fragment thereof. In one aspect, the modification that reduces or eliminates mouse ADAM6 expression is a modification (e.g., an insertion, a deletion, a replacement, etc.) in a mouse immunoglobulin locus. In one embodiment, the immunoglobulin locus is an immunoglobulin heavy chain locus.

In one embodiment, the reduction or loss of ADAM6 function comprises an inability or substantial inability of the mouse to produce sperm that can travel from a mouse uterus through a mouse oviduct to fertilize a mouse egg. In a specific embodiment, at least about 95%, 96%, 97%, 98%, or 99% of the sperm cells produced in an ejaculate volume of the mouse are incapable of traversing through an oviduct in vivo following copulation and fertilizing a mouse ovum.

In one embodiment, the reduction or loss of ADAM6 function comprises an inability to form or substantial inability to form a complex of ADAM2 and/or ADAM3 and/or ADAM6 on a surface of a sperm cell of the mouse. In one embodiment, the loss of ADAM6 function comprises a substantial: inability to fertilize a mouse egg by copulation with a female mouse.

In one aspect, a mouse is provided that lacks a functional endogenous ADAM6 gene, and comprises a protein (or an ectopic nucleotide sequence that encodes a protein) that confers ADAM6 functionality on the mouse. In one embodiment, the mouse is a male mouse and the functionality comprises enhanced fertility as compared with a mouse that lacks a functional endogenous ADAM6 gene.

In one embodiment, the protein is encoded by a genomic sequence located within an immunoglobulin locus in the germline of the mouse. In a specific embodiment, the immunoglobulin locus is a heavy chain locus. In another specific embodiment, the heavy chain locus comprises a single human $V_H$, at least one human $D_H$ and at least one human $J_H$ gene segment. In another specific embodiment, the heavy chain locus comprises one human $V_H$ gene segment, 27 human $D_H$ gene segments, and six human $J_H$ gene segments. In one embodiment, the ectopic protein is encoded by a genomic sequence located within a non-immunoglobulin locus in the germline of the mouse. In one embodiment, the non-immunoglobulin locus is a transcriptionally active locus. In a specific embodiment, the transcriptionally active locus is the ROSA26 locus. In a specific embodiment, the transcriptionally active locus is associated with tissue-specific expression. In one embodiment, the tissue-specific expression is present in reproductive tissues. In one embodiment, the protein is encoded by a genomic sequence randomly inserted into the germline of the mouse.

In one embodiment, the mouse comprises a human or chimeric human/mouse or chimeric human/rat light chain (e.g., human variable, mouse or rat constant) and a chimeric human variable/mouse or rat constant heavy chain. In a specific embodiment, the mouse comprises a transgene that comprises a chimeric human variable/rat or mouse constant light chain gene operably linked to a transcriptionally active promoter, e.g., a ROSA26 promoter. In a further specific embodiment, the chimeric human/mouse or rat light chain transgene comprises a rearranged human light chain variable region sequence in the germline of the mouse.

In one embodiment, the ectopic nucleotide sequence is located within an immunoglobulin locus in the germline of the mouse. In a specific embodiment, the immunoglobulin locus is a heavy chain locus. In one embodiment, the heavy chain locus comprises a single human $V_H$, at least one human $D_H$ and at least one human $J_H$ gene segment. In a specific embodiment, the heavy chain locus comprises a single human $V_H$, 27 human $D_H$ gene segments and six human $J_H$ gene segments. In one embodiment, the ectopic nucleotide sequence is located within a non-immunoglobulin locus in the germline of the mouse. In one embodiment, the non-immunoglobulin locus is a transcriptionally active locus. In a specific embodiment, the transcriptionally active locus is the ROSA26 locus. In one embodiment, the ectopic nucleotide sequence is positioned randomly inserted into the germline of the mouse.

In one aspect, a mouse is provided that lacks a functional endogenous ADAM6 gene, wherein the mouse comprises an ectopic nucleotide sequence that complements the loss of mouse ADAM6 function. In one embodiment, the ectopic nucleotide sequence confers upon the mouse an ability to produce offspring that is comparable to a corresponding wild-type mouse that contains a functional endogenous ADAM6 gene. In one embodiment, the sequence confers upon the mouse an ability to form a complex of ADAM2 and/or ADAM3 and/or ADAM6 on the surface of sperm cell of the mouse. In one embodiment, the sequence confers upon the mouse an ability to travel from a mouse uterus through a mouse oviduct to a mouse ovum to fertilize the ovum.

In one embodiment, the mouse lacking the functional endogenous ADAM6 gene and comprising the ectopic nucleotide sequence produces at least about 50%, 60%, 70%, 80%, or 90% of the number of litters a wild-type mouse of the same age and strain produces in a six-month time period.

In one embodiment, the mouse lacking the functional endogenous ADAM6 gene and comprising the ectopic nucleotide sequence produces at least about 1.5-fold, about 2-fold, about 2.5-fold, about 3-fold, about 4-fold, about 6-fold, about 7-fold, about 8-fold, or about 10-fold or more progeny when bred over a six-month time period than a mouse of the same age and the same or similar strain that lacks the functional endogenous ADAM6 gene and that lacks the ectopic nucleotide sequence that is bred over substantially the same time period and under substantially the same conditions.

In one embodiment, the mouse lacking the functional endogenous ADAM6 gene and comprising the ectopic nucleotide sequence produces an average of at least about 2-fold, 3-fold, or 4-fold higher number of pups per litter in a 4- or 6-month breeding period than a mouse that lacks the functional endogenous ADAM6 gene and that lacks the ectopic nucleotide sequence, and that is bred for the same period of time.

In one embodiment, the mouse lacking the functional endogenous ADAM6 gene and comprising the ectopic nucleotide sequence is a male mouse, and the male mouse produces sperm that when recovered from oviducts at about 5-6 hours post-copulation reflects an oviduct migration that is at least 10-fold, at least 20-fold, at least 30-fold, at least 40-fold, at least 50-fold, at least 60-fold, at least 70-fold, at least 80-fold, at least 90-fold, 100-fold, 110-fold, or 120-fold or higher than a mouse that lacks the functional endogenous ADAM6 gene and that lacks the ectopic nucleotide sequence.

In one embodiment, the mouse lacking the functional endogenous ADAM6 gene and comprising the ectopic nucleotide sequence when copulated with a female mouse generates sperm that is capable of traversing the uterus and entering and traversing the oviduct within about 6 hours at an efficiency that is about equal to sperm from a wild-type mouse.

In one embodiment, the mouse lacking the functional endogenous ADAM6 gene and comprising the ectopic nucleotide sequence produces about 1.5-fold, about 2-fold, about 3-fold, or about 4-fold or more litters in a comparable period of time than a mouse that lacks the functional ADAM6 gene and that lacks the ectopic nucleotide sequence.

In one aspect, a mouse comprising in its germline a non-mouse nucleic acid sequence that encodes an immunoglobulin protein is provided, wherein the non-mouse immunoglobulin sequence comprises an insertion of a mouse ADAM6 gene or homolog or ortholog or functional fragment thereof. In one embodiment, the non-mouse immunoglobulin sequence comprises a human immunoglobulin sequence. In one embodiment, the sequence comprises a human immunoglobulin heavy chain sequence. In one embodiment, the sequence comprises a human immunoglobulin light chain sequence. In one embodiment, the sequence comprises a single $V_H$ gene segment, one or more $D_H$ gene segments, and one or more $J_H$ gene segments; in one embodiment, the sequence comprises one or more $V_L$ gene segments and one or more $J_L$ gene segments. In one embodiment, the single $V_H$, one or more $D_H$, and one or more $J_H$ gene segments, or one or more $V_L$ and $J_L$ gene segments, are not rearranged. In one embodiment, the single $V_H$, one or more $D_H$, and one or more $J_H$ gene segments, or one or more $V_L$ and $J_L$ gene segments, are rearranged. In one embodiment, following rearrangement of the single $V_H$, one or more $D_H$, and one or more $J_H$ gene segments, or one or more $V_L$ and $J_L$ gene segments, the mouse comprises in its genome at least one nucleic acid sequence encoding a mouse ADAM6 gene or homolog or ortholog or functional fragment thereof. In one embodiment, following rearrangement the mouse comprises in its genome at least two nucleic acid sequences encoding a mouse ADAM6 gene or homolog or ortholog or functional fragment thereof. In one embodiment, following rearrangement the mouse comprises in its genome at least one nucleic acid sequence encoding a mouse ADAM6 gene or homolog or ortholog or functional fragment thereof. In one embodiment, the mouse comprises the ADAM6 gene or homolog or ortholog or functional fragment thereof in a B cell. In one embodiment, the mouse comprises the ADAM6 gene or homolog or ortholog or functional fragment thereof in a non-B cell.

In one aspect, mice are provided that express a human immunoglobulin heavy chain variable region or functional fragment thereof from an endogenous mouse immunoglobulin heavy chain locus, wherein the mice comprise an ADAM6 activity that is functional in a male mouse. In one embodiment, the human immunoglobulin heavy chain variable region comprises a polymorphic human $V_H$ gene segment. In one embodiment, the human immunoglobulin heavy chain variable region comprises a human $V_H1$-69 gene segment. In one embodiment, the human immunoglobulin heavy chain variable region comprises a human $V_H1$-2 gene segment.

In one embodiment, the male mice comprise a single unmodified endogenous ADAM6 allele or ortholog of homolog or functional fragment thereof at an endogenous ADAM6 locus.

In one embodiment, the male mice comprise an ectopic mouse ADAM6 sequence or homolog or ortholog or functional fragment thereof that encodes a protein that confers ADAM6 function.

In one embodiment, the male mice comprise an ADAM6 sequence or homolog or ortholog or functional fragment thereof at a location in the mouse genome that approximates the location of the endogenous mouse ADAM6 allele, e.g., 3' of a V gene segment sequence and 5' of an initial D gene segment. In a specific embodiment, the male mice comprise an ADAM6 sequence or homolog or ortholog or functional fragment thereof 3' of a human $V_H$ gene segment and 5' of a human $D_H$ gene segment. In another specific embodiment, the male mice comprise an ADAM6 sequence or homolog or ortholog or functional fragment thereof 5' of a human $V_H$ gene segment. In another specific embodiment, the male mice comprise an ADAM6 sequence or homolog or ortholog or functional fragment thereof 5' of a chimeric heavy chain locus comprising a single human $V_H$ gene segment, one or more $D_H$ gene segments, and one or more $J_H$ gene segments. In one embodiment, the chimeric heavy chain locus comprises a human $V_H1$-69 gene segment, 27 human $D_H$ gene segments, and six human $J_H$ gene segments. In one embodiment, the chimeric heavy chain locus comprises a human $V_H1$-2 gene segment, 27 human $D_H$ gene segments, and six human $J_H$ gene segments.

In one embodiment, the male mice comprise an ADAM6 sequence or homolog or ortholog or functional fragment thereof flanked upstream, downstream, or upstream and downstream (with respect to the direction of transcription of the ADAM6 sequence) of a nucleic acid sequence encoding an immunoglobulin variable gene segment or an immunoglobulin diversity gene segment. In a specific embodiment, the immunoglobulin variable gene segment is a human gene segment. In one embodiment, the immunoglobulin variable gene segment is a human gene segment, and the sequence encoding the mouse ADAM6 or ortholog or homolog or fragment thereof functional in a mouse is between human $V_H$ gene segments; in one embodiment, the mouse comprises one human $V_H$ gene segment, and the sequence is at a position 5' of the $V_H$ gene segment; in one embodiment, the sequence is at a position 3' of the $V_H$ gene segment; in one embodiment, the sequence is at a position between the $V_H$ gene segment and the first $D_H$ gene segment. In a specific embodiment, the $D_H$ gene segment is the first $D_H$ gene segment. In one embodiment, the mouse comprises two $V_H$ gene segments, and the sequence is at a position between the two $V_H$ gene segments; in one embodiment, the sequence is at a position between a $V_H$ gene segment and a $D_H$ gene segment. In a specific embodiment, the $D_H$ gene segment is the first $D_H$ gene segment.

In one embodiment, the male mice comprise an ADAM6 sequence or homolog or ortholog or functional fragment thereof that is located at a position in an endogenous immunoglobulin locus that is the same or substantially the same as in a wild type male mouse. In a specific embodiment, the endogenous locus is incapable of encoding the heavy chain of an antibody. In a specific embodiment, the endogenous locus is positioned at a location in the genome of the male mouse that renders it incapable of encoding the heavy chain of an antibody. In various embodiments, the male mice comprise an ADAM6 sequence located on the same chromosome as human immunoglobulin gene segments and the ADAM6 sequence encodes a functional ADAM6 protein.

In one aspect, a male mouse is provided that comprises a nonfunctional endogenous ADAM6 gene, or a deletion of an endogenous ADAM6 gene, in its germline; wherein sperm cells of the mouse are capable of transiting an oviduct of a female mouse and fertilizing an egg. In one embodiment, the mice comprise an extrachromosomal copy of a mouse ADAM6 gene or ortholog or homolog or functional fragment thereof that is functional in a male mouse. In one embodiment, the mice comprise an ectopic mouse ADAM6 gene or ortholog or homolog or functional fragment thereof that is functional in a male mouse.

In one aspect, mice are provided that comprise a genetic modification that reduces endogenous mouse ADAM6 function, wherein the mouse comprises at least some ADAM6 functionality provided either by an endogenous unmodified allele that is functional in whole or in part (e.g., a heterozygote), or by expression from an ectopic sequence that encodes an ADAM6 or an ortholog or homolog or functional fragment thereof that is functional in a male mouse.

In one embodiment, the mice comprise ADAM6 function sufficient to confer upon male mice the ability to generate offspring by mating, as compared with male mice that lack a functional ADAM6. In one embodiment, the ADAM6 function is conferred by the presence of an ectopic nucleotide sequence that encodes a mouse ADAM6 or a homolog or ortholog or functional fragment thereof. In one embodiment, the ADAM6 function is conferred by an endogenous ADAM6 gene present in an endogenous immunoglobulin locus, wherein the endogenous immunoglobulin locus is incapable of encoding the heavy chain of an antibody. ADAM6 homologs or orthologs or fragments thereof that are functional in a male mouse include those that restore, in whole or in part, the loss of ability to generate offspring observed in a male mouse that lacks sufficient endogenous mouse ADAM6 activity, e.g., the loss in ability observed in an ADAM6 knockout mouse. In this sense ADAM6 knockout mice include mice that comprise an endogenous locus or fragment thereof, but that is not functional, i.e., that does not express ADAM6 (ADAM6a and/or ADAM6b) at all, or that expresses ADAM6 (ADAM6a and/or ADAM6b) at a level that is insufficient to support an essentially normal ability to generate offspring of a wild-type male mouse. The loss of function can be due, e.g., to a modification in a structural gene of the locus (i.e., in an ADAM6a or ADAM6b coding region) or in a regulatory region of the locus (e.g., in a sequence 5' to the ADAM6a gene, or 3' of the ADAM6a or ADAM6b coding region, wherein the sequence controls, in whole or in part, transcription of an ADAM6 gene, expression of an ADAM6 RNA, or expression of an ADAM6 protein). In various embodiments, orthologs or homologs or fragments thereof that are functional in a male mouse are those that enable a sperm of a male mouse (or a majority of sperm cells in the ejaculate of a male mouse) to transit a mouse oviduct and fertilize a mouse ovum.

In one embodiment, male mice that express the human immunoglobulin variable region or functional fragment thereof comprise sufficient ADAM6 activity to confer upon the male mice the ability to generate offspring by mating with female mice and, in one embodiment, the male mice exhibit an ability to generate offspring when mating with female mice that is in one embodiment at least 25%, in one embodiment, at least 30%, in one embodiment at least 40%, in one embodiment at least 50%, in one embodiment at least 60%, in one embodiment at least 70%, in one embodiment at least 80%, in one embodiment at least 90%, and in one embodiment about the same as, that of mice with one or two endogenous unmodified ADAM6 alleles.

In one embodiment male mice express sufficient ADAM6 (or an ortholog or homolog or functional fragment thereof) to enable a sperm cell from the male mice to traverse a female mouse oviduct and fertilize a mouse egg.

In one embodiment, the ADAM6 functionality is conferred by a nucleic acid sequence that is contiguous with a mouse chromosomal sequence (e.g., the nucleic acid is randomly integrated into a mouse chromosome; or placed at a specific location, e.g., by targeting the nucleic acid to a specific location, e.g., by site-specific recombinase-mediated (e.g., Cre-mediated) insertion or homologous recombination). In one embodiment, the ADAM6 sequence is present on a nucleic acid that is distinct from a chromosome of the mouse (e.g., the ADAM6 sequence is present on an episome, i.e., extrachromosomally, e.g., in an expression construct, a vector, a YAC, a transchromosome, etc.).

In one aspect, genetically modified mice and cells are provided that comprise a modification of an endogenous immunoglobulin heavy chain locus, wherein the mice express at least a portion of an immunoglobulin heavy chain sequence, e.g., at least a portion of a human sequence, wherein the mice comprise an ADAM6 activity that is functional in a male mouse. In one embodiment, the modification reduces or eradicates ADAM6 activity of the mouse. In one embodiment, the mouse is modified such that both alleles that encode ADAM6 activity are either absent or express an ADAM6 that does not substantially function to support normal mating in a male mouse. In one embodiment, the mouse further comprises an ectopic nucleic acid sequence encoding a mouse ADAM6 or ortholog or homolog or functional fragment thereof. In one embodiment, the modification maintains ADAM6 activity of the mouse and renders an endogenous immunoglobulin heavy chain locus incapable of encoding a heavy chain of an antibody. In a specific embodiment, the modification includes chromosomal inversions and or translocations that render the endogenous immunoglobulin heavy chain locus incapable of encoding a heavy chain of an antibody.

In one aspect, genetically modified mice and cells are provided that comprise a modification of an endogenous immunoglobulin heavy chain locus, wherein the modification reduces or eliminates ADAM6 activity expressed from an ADAM6 sequence of the locus, and wherein the mice comprise an ADAM6 protein or ortholog or homolog or functional fragment thereof. In various embodiments, the ADAM6 protein or fragment thereof is encoded by an ectopic ADAM6 sequence. In various embodiments, the ADAM6 protein or fragment thereof is expressed from an endogenous ADAM6 allele. In various embodiments, the mouse comprises a first immunoglobulin heavy chain allele comprises a first modification that reduces or eliminates expression of a functional ADAM6 from the first immunoglobulin heavy chain allele, and the mouse comprises a second immunoglobulin heavy chain allele that comprises a second modification that does not substantially reduce or does not eliminate expression of a functional ADAM6 from the second immunoglobulin heavy chain allele.

In one embodiment, the second modification is located 3' (with respect to the transcriptional directionality of the mouse V gene segment) of a final mouse V gene segment and located 5' (with respect to the transcriptional directionality of the constant sequence) of a mouse (or chimeric human/mouse) immunoglobulin heavy chain constant gene or fragment thereof (e.g., a nucleic acid sequence encoding a human and/or mouse: $C_H1$ and/or hinge and/or $C_H2$ and/or $C_H3$).

In one embodiment, the modification is at a first immunoglobulin heavy chain allele at a first locus that encodes a first ADAM6 allele, and the ADAM6 function results from expression of an endogenous ADAM6 at a second immunoglobulin heavy chain allele at a second locus that encodes a functional ADAM6, wherein the second immunoglobulin heavy chain allele comprises at least one modification of a V, D, and/or J gene segment. In a specific embodiment, the at least one modification of the V, D, and or J gene segment is a deletion, a replacement with a single human $V_H$, one or more $D_H$, and/or one or more $J_H$ gene segments, a replacement with a camelid $V_H$ (or $V_{HH}$), $D_H$, and/or $J_H$ gene segment, a replacement with a humanized or camelized $V_H$ (or $V_{HH}$), $D_H$, and/or $J_H$ gene segment, a replacement of a heavy chain sequence with a light chain sequence, and a combination thereof. In one embodiment, the at least one modification is the deletion of one or more $V_H$, $D_H$, and/or $J_H$ gene segments and a replacement with one or more $V_L$ and/or $J_L$ gene segments (e.g., a human $V_L$ and/or $J_L$ gene segment) at the heavy chain locus.

In one embodiment, the modification is at a first immunoglobulin heavy chain allele at a first locus and a second immunoglobulin heavy chain allele at a second locus, and the ADAM6 function results from expression of an ectopic ADAM6 at a non-immunoglobulin locus in the germline of the mouse. In a specific embodiment, the non-immunoglobulin locus is the ROSA26 locus. In a specific embodiment, the non-immunoglobulin locus is transcriptionally active in reproductive tissue.

In one embodiment, the modification is at a first immunoglobulin heavy chain allele at a first locus and a second immunoglobulin heavy chain allele at a second locus, and the ADAM6 function results from expression of an ectopic ADAM6 at the first immunoglobulin heavy chain allele. In one embodiment, the modification is at a first immunoglobulin heavy chain allele at a first locus and a second immunoglobulin heavy chain allele at a second locus, and the ADAM6 function results from expression of an ectopic ADAM6 at the second immunoglobulin heavy chain allele.

In one aspect, a mouse comprising a heterozygous or a homozygous knockout of ADAM6 is provided. In one embodiment, the mouse further comprises a modified immunoglobulin sequence that is a human or a humanized immunoglobulin sequence, or a camelid or camelized human or mouse immunoglobulin sequence. In one embodiment, the modified immunoglobulin sequence is present at the endogenous mouse heavy chain immunoglobulin locus. In one embodiment, the modified immunoglobulin sequence comprises a human heavy chain variable gene sequence at an endogenous mouse immunoglobulin heavy chain locus. In one embodiment, the human heavy chain variable gene sequence replaces an endogenous mouse heavy chain variable gene sequence at the endogenous mouse immunoglobulin heavy chain locus.

In one aspect, a mouse incapable of expressing a functional endogenous mouse ADAM6 from an endogenous mouse ADAM6 locus is provided. In one embodiment, the mouse comprises an ectopic nucleic acid sequence that encodes an ADAM6, or functional fragment thereof, that is functional in the mouse. In a specific embodiment, the ectopic nucleic acid sequence encodes a protein that rescues a loss in the ability to generate offspring exhibited by a male mouse that is homozygous for an ADAM6 knockout. In a specific embodiment, the ectopic nucleic acid sequence encodes a mouse ADAM6 protein.

In one aspect, a mouse is provided that lacks a functional endogenous ADAM6 locus, and that comprises an ectopic nucleic acid sequence that confers upon the mouse ADAM6 function. In one embodiment, the nucleic acid sequence comprises an endogenous mouse ADAM6 sequence or functional fragment thereof. In one embodiment, the endogenous mouse ADAM6 sequence comprises ADAM6a- and ADAM6b-encoding sequence located in a wild-type mouse between the 3'-most mouse immunoglobulin heavy chain V gene segment ($V_H$) and the 5'-most mouse immunoglobulin heavy chain D gene segment ($D_H$).

In one embodiment, the nucleic acid sequence comprises a sequence encoding mouse ADAM6a or functional fragment thereof and/or a sequence encoding mouse ADAM6b or functional fragment thereof, wherein the ADAM6a and/or ADAM6b or functional fragment(s) thereof is operably linked to a promoter. In one embodiment, the promoter is a human promoter. In one embodiment, the promoter is the mouse ADAM6 promoter. In a specific embodiment, the ADAM6 promoter comprises sequence located between the first codon of the first ADAM6 gene closest to the mouse 5'-most $D_H$ gene segment and the recombination signal sequence of the 5'-most $D_H$ gene segment, wherein 5' is indicated with respect to direction of transcription of the mouse immunoglobulin genes. In one embodiment, the promoter is a viral promoter. In a specific embodiment, the viral promoter is a cytomegalovirus (CMV) promoter. In one embodiment, the promoter is a ubiquitin promoter.

In one embodiment, the promoter is an inducible promoter. In one embodiment, the inducible promoter regulates expression in non-reproductive tissues. In one embodiment, the inducible promoter regulates expression in reproductive tissues. In a specific embodiment, the expression of the mouse ADAM6a and/or ADAM6b sequences or functional fragments(s) thereof is developmentally regulated by the inducible promoter in reproductive tissues.

In one embodiment, the mouse ADAM6a and/or ADAM6b are selected from the ADAM6a of SEQ ID NO: 1 and/or ADAM6b of sequence SEQ ID NO: 2.

In one embodiment, the mouse ADAM6 promoter is a promoter of SEQ ID NO: 3. In a specific embodiment, the mouse ADAM6 promoter comprises the nucleic acid sequence of SEQ ID NO: 3 directly upstream (with respect to the direction of transcription of ADAM6a) of the first codon of ADAM6a and extending to the end of SEQ ID NO: 3 upstream of the ADAM6 coding region. In another specific embodiment, the ADAM6 promoter is a fragment extending from within about 5 to about 20 nucleotides upstream of the start codon of ADAM6a to about 0.5 kb, 1 kb, 2 kb, or 3 kb or more upstream of the start codon of ADAM6a.

In one embodiment, the mouse ADAM6 promoter is a promoter of SEQ ID NO: 73. In a specific embodiment, the mouse ADAM6 promoter comprises the nucleic acid sequence of SEQ ID NO: 73 directly upstream (with respect to the direction of transcription of ADAM6a) of the first codon of ADAM6a and extending to the end of SEQ ID NO: 73 upstream of the ADAM6 coding region. In another specific embodiment, the ADAM6 promoter is a fragment extending from within about 5 to about 20 nucleotides upstream of the start codon of ADAM6a to about 0.5 kb, 1 kb, 2 kb, or 3 kb or more upstream of the start codon of ADAM6a.

In one embodiment, the mouse ADAM6 promoter is a promoter of SEQ ID NO: 77. In a specific embodiment, the mouse ADAM6 promoter comprises the nucleic acid sequence of SEQ ID NO: 77 directly upstream (with respect to the direction of transcription of ADAM6a) of the first codon of ADAM6a and extending to the end of SEQ ID NO: 77 upstream of the ADAM6 coding region. In another specific embodiment, the ADAM6 promoter is a fragment extending from within about 5 to about 20 nucleotides upstream of the start codon of ADAM6a to about 0.5 kb, 1 kb, 2 kb, or 3 kb or more upstream of the start codon of ADAM6a.

In one embodiment, the nucleic acid sequence comprises SEQ ID NO: 3 or a fragment thereof that when placed into a mouse that is infertile or that has low fertility due to a lack of ADAM6, improves fertility or restores fertility to about a wild-type fertility. In one embodiment, SEQ ID NO: 3 or a fragment thereof confers upon a male mouse the ability to produce a sperm cell that is capable of traversing a female mouse oviduct in order to fertilize a mouse egg.

In one embodiment, the nucleic acid sequence comprises SEQ ID NO: 73 or a fragment thereof that when placed into a mouse that is infertile or that has low fertility due to a lack of ADAM6, improves fertility or restores fertility to about a wild-type fertility. In one embodiment, SEQ ID NO: 73 or a fragment thereof confers upon a male mouse the ability to produce a sperm cell that is capable of traversing a female mouse oviduct in order to fertilize a mouse egg.

In one embodiment, the nucleic acid sequence comprises SEQ ID NO: 77 or a fragment thereof that when placed into a mouse that is infertile or that has low fertility due to a lack of ADAM6, improves fertility or restores fertility to about a wild-type fertility. In one embodiment, SEQ ID NO: 77 or a fragment thereof confers upon a male mouse the ability to produce a sperm cell that is capable of traversing a female mouse oviduct in order to fertilize a mouse egg.

In one aspect, a mouse is provided that comprises a deletion of an endogenous nucleotide sequence that encodes an ADAM6 protein, a replacement of an endogenous mouse $V_H$ gene segment with a human $V_H$ gene segment, and an ectopic nucleotide sequence that encodes a mouse ADAM6 protein or ortholog or homolog or fragment thereof that is functional in a male mouse.

In one embodiment, the mouse comprises an immunoglobulin heavy chain locus that comprises a deletion of an endogenous immunoglobulin locus nucleotide sequence that comprises an endogenous ADAM6 gene, comprises a nucleotide sequence encoding one or more human immunoglobulin gene segments, and wherein the ectopic nucleotide sequence encoding the mouse ADAM6 protein is within or directly adjacent to the nucleotide sequence encoding the one or more human immunoglobulin gene segments.

In one embodiment, the mouse comprises a replacement of all or substantially all endogenous $V_H$ gene segments with a nucleotide sequence encoding a single human $V_H$ gene segment, and the ectopic nucleotide sequence encoding the mouse ADAM6 protein is within, or directly adjacent to, the nucleotide sequence encoding the single human $V_H$ gene segment. In one embodiment, the mouse further comprises a replacement of one or more endogenous $D_H$ gene segments with one or more human $D_H$ gene segments at the endogenous $D_H$ gene locus. In one embodiment, the mouse further comprises a replacement of one or more endogenous $J_H$ gene segments with one or more human $J_H$ gene segments at the endogenous $J_H$ gene locus. In one embodiment, the mouse comprises a replacement of all or substantially all endogenous $V_H$, $D_H$, and $J_H$ gene segments and a replacement at the endogenous $V_H$, $D_H$, and $J_H$ gene loci with a single human $V_H$, one or more human $D_H$, and one or more human $J_H$ gene segments, wherein the mouse comprises an ectopic sequence encoding a mouse ADAM6 protein. In a specific embodiment, the ectopic sequence encoding the mouse ADAM6 protein is placed upstream or 5' of the single human $V_H$ gene segment. In another specific embodiment, the ectopic sequence encoding the mouse ADAM6 protein is placed downstream or 3' of the single human $V_H$ gene segment. In another specific embodiment, the ectopic sequence encoding the mouse ADAM6 protein is placed between the single human $V_H$ gene segment and the first human $D_H$ gene segment present. In another specific embodiment, the mouse comprises a deletion of all or substantially all mouse $V_H$ gene segments, and a replacement with a single human $V_H$ gene segment, and the ectopic nucleotide sequence encoding the mouse ADAM6 protein is placed downstream of human gene segment $V_H$1-69 and upstream of human gene segment $D_H$1-1. In another specific embodiment, the mouse comprises a deletion of all or substantially all mouse $V_H$ gene segments, and a replacement with a single human $V_H$ gene segment, and the ectopic nucleotide sequence encoding the mouse ADAM6 protein is placed downstream of human gene segment $V_H$1-2 and upstream of human gene segment $D_H$1-1.

In a specific embodiment, the mouse comprises a replacement of all or substantially all endogenous $V_H$ gene segments with a nucleotide sequence encoding a single $V_H$ gene segments, and the ectopic nucleotide sequence encoding the mouse ADAM6 protein is within, or directly adjacent to, the nucleotide sequence encoding the single human $V_H$ gene segment.

In one embodiment, the ectopic nucleotide sequence that encodes the mouse ADAM6 protein is present on a transgene in the genome of the mouse. In one embodiment, the ectopic nucleotide sequence that encodes the mouse ADAM6 protein is present extrachromosomally in the mouse.

In one aspect, a mouse is provided that comprises a modification of an endogenous immunoglobulin heavy chain locus, wherein the mouse expresses a B cell that comprises a rearranged immunoglobulin sequence operably linked to a heavy chain constant region gene sequence, and the B cell comprises in its genome (e.g., on a B cell chromosome) a gene encoding an ADAM6 or ortholog or homolog or fragment thereof that is functional in a male mouse. In one embodiment, the rearranged immunoglobulin sequence operably linked to the heavy chain constant region gene sequence comprises a human heavy chain V, D, and/or J sequence; a mouse heavy chain V, D, and/or J sequence; a human or mouse light chain V and/or J sequence. In one embodiment, the heavy chain constant region gene sequence comprises a human or a mouse heavy chain sequence selected from the group consisting of a $C_H$1, a hinge, a $C_H$2, a $C_H$3, and a combination thereof.

In one aspect, a mouse is provided that comprises a functionally silenced endogenous immunoglobulin heavy chain locus, wherein ADAM6 function is maintained in the mouse, and further comprises an insertion of one or more human immunoglobulin gene segments, wherein the one or more human immunoglobulin gene segments include a single human $V_H$ gene segment, one or more human $D_H$ gene segments, and one or more human $J_H$ gene segments. In one embodiment, the one or more human immunoglobulin gene segments includes a human $V_H$1-69 gene segment, 27 human $D_H$ gene segments, and six human $J_H$ gene segments. In one embodiment, the one or more human immunoglobulin gene segments include a human $V_H$1-2 gene segment, 27 human $D_H$ gene segments, and six human $J_H$ gene segments.

In one aspect, a genetically modified mouse is provided, wherein the mouse comprises a functionally silenced immunoglobulin light chain gene, and further comprises a replacement of one or more endogenous immunoglobulin heavy chain variable region gene segments with a single human immunoglobulin heavy chain variable region gene segment, wherein the mouse lacks a functional endogenous ADAM6 locus, and wherein the mouse comprises an ectopic nucleotide sequence that expresses a mouse ADAM6 protein or an ortholog or homolog or fragment thereof that is functional in a male mouse.

In one aspect, a mouse is provided that lacks a functional endogenous mouse ADAM6 locus or sequence and that comprises an ectopic nucleotide sequence encoding a mouse ADAM6 locus or functional fragment of a mouse ADAM6 locus or sequence, wherein the mouse is capable of mating with a mouse of the opposite sex to produce a progeny that comprises the ectopic ADAM6 locus or sequence. In one embodiment, the mouse is male. In one embodiment, the mouse is female.

In one aspect, a genetically modified mouse is provided, wherein the mouse comprises a human immunoglobulin heavy chain variable region gene segment at an endogenous mouse immunoglobulin heavy chain variable region gene locus, the mouse lacks an endogenous functional ADAM6 sequence at the endogenous mouse immunoglobulin heavy chain variable region gene locus, and wherein the mouse comprises an ectopic nucleotide sequence that expresses a mouse ADAM6 protein or an ortholog or homolog or fragment thereof that is functional in a male mouse.

In one embodiment, the ectopic nucleotide sequence that expresses the mouse ADAM6 protein is extrachromosomal. In one embodiment, the ectopic nucleotide sequence that expresses the mouse ADAM6 protein is integrated at one or more loci in a genome of the mouse. In a specific embodiment, the one or more foci include an immunoglobulin locus.

In one aspect, a mouse is provided that expresses an immunoglobulin heavy chain sequence from a modified endogenous mouse immunoglobulin heavy chain locus, wherein the heavy chain is derived from a human V gene segment, a D gene segment, and a J gene segment, wherein the mouse comprises an ADAM6 activity that is functional in the mouse.

In one embodiment, the mouse comprises a single human V gene segment, a plurality of D gene segments, and a plurality of J gene segments. In one embodiment, the D gene segments are human D gene segments. In one embodiment, the J gene segments are human J gene segments. In one embodiment, the mouse further comprises a humanized heavy chain constant region sequence, wherein the humanization comprises replacement of a sequence selected from a $C_H1$, hinge, $C_H2$, $C_H3$, and a combination thereof. In a specific embodiment, the heavy chain is derived from the human V gene segment, a human D gene segment, a human J gene segment, a human $C_H1$ sequence, a human or mouse hinge sequence, a mouse $C_H2$ sequence, and a mouse $C_H3$ sequence. In another specific embodiment, the mouse further comprises a human light chain constant sequence.

In one embodiment, the mouse comprises an ADAM6 gene that is flanked 5' and 3' by endogenous immunoglobulin heavy chain gene segments. In a specific embodiment, the endogenous immunoglobulin heavy chain gene segments are incapable of encoding a heavy chain of an antibody. In a specific embodiment, the ADAM6 gene of the mouse is at a position that is the same as in a wild-type mouse and the endogenous immunoglobulin heavy chain variable gene loci of the mouse are incapable of rearranging to encode a heavy chain of an antibody.

In one embodiment, the V gene segment is flanked 5' (with respect to transcriptional direction of the V gene segment) by a sequence encoding an ADAM6 activity that is functional in the mouse.

In one embodiment, the V gene segment is flanked 3' (with respect to transcriptional direction of the V gene segment) by a sequence encoding an ADAM6 activity that is functional in the mouse.

In one embodiment, the D gene segment is flanked 5' (with respect to transcriptional direction of the D gene segment) by a sequence encoding an ADAM6 activity that is functional in the mouse.

In one embodiment, the J gene segment is flanked 5' (with respect to transcriptional direction of the J gene segment) by a sequence encoding an ADAM6 activity that is functional in the mouse.

In one embodiment, the ADAM6 activity that is functional in the mouse results from expression of a nucleotide sequence located 5' of the 5'-most D gene segment and 3' of the single V gene segment (with respect to the direction of transcription of the V gene segment) of the modified endogenous mouse heavy chain immunoglobulin locus.

In one embodiment, the ADAM6 activity that is functional in the mouse results from expression of a nucleotide sequence located 5' of the 5'-most J gene segment and 3' of the 3'-most D gene segment (with respect to the direction of transcription of the D gene segment) of the modified endogenous mouse heavy chain immunoglobulin locus.

In one embodiment, the ADAM6 activity that is functional in the mouse results from expression of a nucleotide sequence located 5' of the single human V gene segment (with respect to the direction of transcription of the V gene segment) of the modified endogenous mouse heavy chain immunoglobulin focus.

In one embodiment, the nucleotide sequence comprises a sequence selected from a mouse ADAM6b sequence or functional fragment thereof, a mouse ADAM6a sequence or functional fragment thereof, and a combination thereof.

In one embodiment, the nucleotide sequence positioned upstream (5') or downstream (3') of the single human V gene segment is placed in opposite transcription orientation with respect to the human V gene segment. In a specific embodiment, nucleotide sequence encodes, from 5' to 3' with respect to the direction of transcription of ADAM6 genes, and ADAM6a sequence followed by an ADAM6b sequence.

In one embodiment, the mouse comprises a single human $V_H$ gene segment juxtaposed or contiguous with a mouse ADAM6 sequence or functional fragment thereof.

In one embodiment, the mouse comprises a human $V_H1$-69 gene segment juxtaposed or contiguous with a mouse ADAM6 sequence or functional fragment thereof.

In one embodiment, the mouse comprises a human $V_H1$-2 gene segment juxtaposed or contiguous with a mouse ADAM6 sequence or functional fragment thereof.

In one embodiment, the mouse comprises a single human $V_H$ gene segment, and the mouse ADAM6 sequence or functional fragment thereof is juxtaposed or contiguous with endogenous immunoglobulin heavy chain gene segments, wherein the endogenous immunoglobulin heavy chain gene segments are incapable of rearranging to encode a heavy chain of an antibody.

In one embodiment, the sequence encoding the ADAM6 activity that is functional in the mouse is a mouse ADAM6 sequence or functional fragment thereof.

In one aspect, a mouse is provided that comprises a nucleic acid sequence encoding a mouse ADAM6 (or homolog or ortholog or functional fragment thereof) in a DNA-bearing cell of non-rearranged B cell lineage, but does not comprise the nucleic acid sequence encoding the mouse ADAM6 (or homolog or ortholog or functional fragment thereof) in a B cell that comprise rearranged immunoglobulin loci, wherein the nucleic acid sequence encoding the mouse ADAM6 (or homolog or ortholog or functional fragment thereof) occurs in the genome at a position that is different from a position in which a mouse ADAM6 gene appears in a wild-type mouse. In one embodiment, the nucleic acid sequence encoding the mouse ADAM6 (or homolog or ortholog or functional fragment thereof) is present in all or substantially all DNA-bearing cells that are not of rearranged B cell lineage; in one embodiment, the nucleic acid sequence is present in germline cells of the mouse, but not in a chromosome of a rearranged B cell.

In one aspect, a mouse is provided that comprises a nucleic acid sequence encoding a mouse ADAM6 (or homolog or ortholog or functional fragment thereof) in all or substantially all DNA-bearing cells, including B cells that comprise rearranged immunoglobulin loci, wherein the nucleic acid sequence encoding the mouse ADAM6 (or homolog or ortholog or functional fragment thereof) occurs in the genome at a position that is different from a position in which a mouse ADAM6 gene appears in a wild-type mouse. In one embodiment, the nucleic acid sequence encoding the mouse ADAM6 (or homolog or ortholog or functional fragment thereof) is on a nucleic acid that is contiguous with the rearranged immunoglobulin locus. In one embodiment, the nucleic acid that is contiguous with the rearranged immunoglobulin locus is a chromosome. In one embodiment, the chromosome is a chromosome that is found in a wild-type mouse and the chromosome comprises a modification of a mouse immunoglobulin locus.

In one aspect, a genetically modified mouse is provided, wherein the mouse comprises a B cell that comprises in its genome an ADAM6 sequence or ortholog or homolog thereof. In one embodiment, the ADAM6 sequence or ortholog or homolog thereof is at an immunoglobulin heavy chain locus. In a specific embodiment, the heavy chain locus comprises endogenous immunoglobulin heavy chain gene segments that are incapable of rearranging to encode the heavy chain of an antibody. In one embodiment, the ADAM6 sequence or ortholog or homolog thereof is at a locus that is not an immunoglobulin locus. In one embodiment, the ADAM6 sequence is on a transgene driven by a heterologous promoter. In a specific embodiment, the heterologous promoter is a non-immunoglobulin promoter. In a specific embodiment, B cell expresses an ADAM6 protein or ortholog or homolog thereof.

In one embodiment, 90% or more of the B cells of the mouse comprise a gene encoding an ADAM6 protein or an ortholog thereof or a homolog thereof or a fragment thereof that is functional in the mouse. In a specific embodiment, the mouse is a male mouse.

In one embodiment, the B cell genome comprises a first allele and a second allele comprising the ADAM6 sequence or ortholog or homolog thereof. In one embodiment, the B cell genome comprises a first allele but not a second allele comprising the ADAM6 sequence or ortholog or homolog thereof.

In one aspect, a mouse is provided that comprises a modification at one or more endogenous immunoglobulin heavy chain alleles, wherein the modification maintains one or more endogenous ADAM6 alleles.

In one embodiment, the modification renders the mouse incapable of expressing a functional heavy chain that comprises rearranged endogenous heavy chain gene segments from at least one heavy chain allele and maintains an endogenous ADAM6 allele located within the at least one endogenous immunoglobulin heavy chain allele.

In one embodiment, the mice are incapable of expressing a functional heavy chain that comprises rearranged endogenous heavy chain gene segments from at least one of the endogenous immunoglobulin heavy chain alleles, and the mice express and ADAM6 protein from an endogenous ADAM6 allele. In a specific embodiment, the mice are incapable of expressing a functional heavy chain that comprises rearranged endogenous heavy chain gene segments from two endogenous immunoglobulin heavy chain alleles, and the mice express an ADAM6 protein from one or more endogenous ADAM6 alleles.

In one embodiment, the mice are incapable of expressing a functional heavy chain from each endogenous heavy chain allele, and the mice comprise an functional ADAM6 allele located within 1, 2, 3, 4, 5, 10, 20, 30, 40, 50, 60, 70, 80, 90, 100, 110, or 120 or more Mbp upstream (with respect to the direction of transcription of the mouse heavy chain locus) of a mouse immunoglobulin heavy chain constant region sequence. In a specific embodiment, the functional ADAM6 allele is at the endogenous immunoglobulin heavy chain locus (e.g., in an intergenic V-D region, between two V gene segments, between a V and a D gene segment, between a D and a J gene segment, etc.). In a specific embodiment, the functional ADAM6 allele is located within a 90 to 100 kb intergenic sequence between the final mouse V gene segment and the first mouse D gene segment.

In one aspect, a mouse is provided that comprises a modification at one or more endogenous ADAM6 alleles.

In one embodiment, the modification renders the mouse incapable of expressing a functional ADAM6 protein from at least one of the one or more endogenous ADAM6 alleles. In a specific embodiment, the mouse is incapable of expressing a functional ADAM6 protein from each of the endogenous ADAM6 alleles.

In one embodiment, the mice are incapable of expressing a functional ADAM6 protein from each endogenous ADAM6 allele, and the mice comprise an ectopic ADAM6 sequence.

In one embodiment, the mice are incapable of expressing a functional ADAM6 protein from each endogenous ADAM6 allele, and the mice comprise an ectopic ADAM6 sequence located within 1, 2, 3, 4, 5, 10, 20, 30, 40, 50, 60, 70, 80, 90, 100, 110, or 120 or more kb upstream (with respect to the direction of transcription of the mouse heavy chain locus) of a mouse immunoglobulin heavy chain constant region sequence. In a specific embodiment, the ectopic ADAM6 sequence is at the endogenous immunoglobulin heavy chain locus (e.g., in an intergenic V-D region, between two V gene segments, between a V and a D gene segment, between a D and a J gene segment, etc.). In a specific embodiment, the ectopic ADAM6 sequence is located within a 90 to 100 kb intergenic sequence between the final mouse V gene segment and the first mouse D gene segment. In another specific embodiment, the endogenous 90 to 100 kb intergenic V-D sequence is removed, and the ectopic ADAM6 sequence is placed between a single human V gene segment and a first human D gene segment. In another specific embodiment, the endogenous 90 to 100 kb intergenic V-D sequence is removed, and the ectopic ADAM6 sequence is placed 5' or upstream of the single human V gene segment.

In one aspect, an infertile male mouse is provided, wherein the mouse comprises a deletion of two or more endogenous ADAM6 alleles. In one aspect, a female mouse is provided that is a carrier of a male infertility trait, wherein the female mouse comprises in its germline a nonfunctional ADAM6 allele or a knockout of an endogenous ADAM6 allele.

In one aspect, a mouse comprising an endogenous immunoglobulin heavy chain V, D, and or J gene segment that are incapable of rearranging to encode an heavy chain of an antibody is provided, wherein the majority of the B cells of the mouse comprise an functional ADAM6 gene.

In one embodiment, the mouse comprises an intact endogenous immunoglobulin heavy chain V, D, and J gene segments that are incapable of rearranging to encode a functional heavy chain of an antibody. In one embodiment, the mouse comprises at least one and up to 89 V gene segments, at least one and up to 13 D gene segments, at least one and up to four J gene segments, and a combination thereof; wherein the at least one and up to 89 V gene segments, at least one and up to 13 D gene segments, at least one and up to four J gene segments are incapable of rearranging to encode a heavy chain variable region of an antibody. In a specific embodiment, the mouse comprises a functional ADAM6 gene located within the intact endogenous immunoglobulin heavy chain V, D, and J gene segments. In one embodiment, the mouse comprises an endogenous heavy chain locus that includes an endogenous ADAM6 locus, wherein the endogenous heavy chain locus comprises 89 V gene segments, 13 D gene segments, and four J gene segments, wherein the endogenous heavy chain gene segments are incapable of rearranging to encode a heavy chain variable region of an antibody and the ADAM6 locus encodes an ADAM6 protein that is functional in the mouse.

In one aspect, a mouse that lacks an endogenous immunoglobulin heavy chain V, D, and J gene segment is provided, wherein a majority of the B cells of the mouse comprise an ADAM6 sequence or ortholog or homolog thereof.

In one embodiment, the mouse lacks endogenous immunoglobulin heavy chain gene segments selected from two or more V gene segments, two or more D gene segments, two or more J gene segments, and a combination thereof. In one embodiment, the mouse lacks immunoglobulin heavy chain gene segments selected from at least one and up to 89 V gene segments, at least one and up to 13 D gene segments, at least one and up to four J gene segments, and a combination thereof. In one embodiment, the mouse lacks a genomic DNA fragment from chromosome 12 comprising about three megabases of the endogenous immunoglobulin heavy chain locus. In a specific embodiment, the mouse lacks all functional endogenous heavy chain V, D, and J gene segments. In a specific embodiment, the mouse lacks 89 $V_H$ gene segments, 13 $D_H$ gene segments and four $J_H$ gene segments.

In one aspect, a mouse is provided, wherein the mouse has a genome in the germline comprising a modification of an immunoglobulin heavy chain locus, wherein the modification to the immunoglobulin heavy chain locus comprises the replacement of one or more mouse immunoglobulin variable region sequences with one non-mouse immunoglobulin variable region sequences, and wherein the mouse comprises a nucleic acid sequence encoding a mouse ADAM6 protein. In a preferred embodiment, the $D_H$ and $J_H$ sequences and at least 3, at least 10, at least 20, at least 40, at least 60, or at least 80 $V_H$ sequences of the endogenous immunoglobulin heavy chain locus are replaced by non-mouse immunoglobulin heavy chain sequences. In a further preferred embodiment, the $D_H$, $J_H$, and all $V_H$ sequences of the endogenous immunoglobulin heavy chain locus are replaced by a single non-mouse immunoglobulin V gene segment, one or more D gene segment, and one or more J gene segment sequences. The non-mouse immunoglobulin sequences can be unrearranged. In a preferred embodiment, the non-mouse immunoglobulin sequences comprise complete unrearranged $D_H$ and $J_H$ regions and a single unrearranged $V_H$ sequence of the non-mouse species. In a further preferred embodiment, the non-mouse immunoglobulin sequences are capable of forming a complete variable region, i.e., a rearranged variable region containing $V_H$, $D_H$, and $J_H$ segments joined together to form a sequence that encodes a heavy chain variable region, of the non-mouse species. The non-mouse species can be *Homo sapiens* and the non-mouse immunoglobulin sequences can be human sequences.

In one aspect, a heavy chain immunoglobulin locus is provided that comprises a single functional human V segment. In one embodiment, the single functional human V segment is selected from a $V_H1$-2, $V_H1$-3, $V_H1$-8, $V_H1$-18, $V_H1$-24, $V_H1$-45, $V_H1$-46, $V_H1$-58, $V_H1$-69, $V_H2$-5, $V_H2$-26, $V_H2$-70, $V_H3$-7, $V_H3$-9, $V_H3$-11, $V_H3$-13, $V_H3$-15, $V_H3$-16, $V_H3$-20, $V_H3$-21, $V_H3$-23, $V_H3$-30, $V_H3$-30-3, $V_H3$-30-5, $V_H3$-33, $V_H3$-35, $V_H3$-38, $V_H3$-43, $V_H3$-48, $V_H3$-49, $V_H3$-53, $V_H3$-64, $V_H3$-66, $V_H3$-72, $V_H3$-73, $V_H3$-74, $V_H4$-4, $V_H4$-28, $V_H4$-30-1, $V_H4$-30-2, $V_H4$-30-4, $V_H4$-31, $V_H4$-34, $V_H4$-39, $V_H4$-59, $V_H4$-61, $V_H5$-51, $V_H6$-1, $V_H7$-4-1, and a $V_H7$-81 segment. In one embodiment, the single functional human V segment is a $V_H1$-69 segment; in a specific embodiment, the single functional human V segment is present in 1, 2, 3, 4, 5, 6, 7, 8, 9, 10, 11, 12, or 13 polymorphic forms found in the human population. In one embodiment, the single functional human V segment is a $V_H1$-2 segment; in a specific embodiment, the single functional human V segment is present in 1, 2, 3, 4, or 5 polymorphic forms found in the human population.

In one embodiment, the heavy chain immunoglobulin locus is a modified locus of a non-human animal. In one embodiment, the modified non-human immunoglobulin heavy chain locus is present in the non-human animal at a position in the genome in which the corresponding unmodified non-human locus is found in the wild-type non-human animal. In one embodiment, the modified non-human immunoglobulin heavy chain locus is present on a transgene in a non-human animal.

In one embodiment, the single functional human V gene segment is a $V_H1$-69 gene segment. In one embodiment, the $V_H1$-69 gene segment comprises SEQ ID NO: 37. In one embodiment, the $V_H1$-69 gene segment is derived from SEQ ID NO: 37. In one embodiment, the $V_H1$-69 gene segment is at least 80%, at least 85%, at least 90%, at least 95%, or at least 98% identical to SEQ ID NO: 37.

In one embodiment, the single functional human V gene segment is encoded by the nucleotide sequence of SEQ ID NO: 37.

In one embodiment, the single functional human V gene segment is a $V_H1$-2 gene segment. In one embodiment, the $V_H1$-2 gene segment comprises SEQ ID NO: 63. In one embodiment, the $V_H1$-2 gene segment is derived from SEQ ID NO: 63. In one embodiment, the $V_H1$-2 gene segment is at least 80%, at least 85%, at least 90%, at least 95%, or at least 98% identical to SEQ ID NO: 63.

In one embodiment, the single functional human V gene segment is encoded by a nucleotide sequence comprising SEQ ID NO: 63.

In one embodiment, the single functional human V segment is operably linked to one or more D segments and one or more J segments, or one or more J segments. In one embodiment, the V segment and one or more D and/or J segments are operably linked to an immunoglobulin heavy chain constant region sequence. In one embodiment the immunoglobulin heavy chain constant region sequence is selected from a $C_H1$, a hinge, a $C_H2$, a $C_H3$ sequence, and a combination thereof. In one embodiment, the $C_H1$, hinge, $C_H2$, $C_H3$, or combination thereof are each non-human endogenous constant sequences. In one embodiment, at least one of the $C_H1$, hinge, $C_H2$, $C_H3$, or combination thereof is a human sequence. In a specific embodiment, the $C_H1$ and/or hinge are human sequences.

In one aspect, a modified endogenous non-human immunoglobulin heavy chain locus is provided, comprising a replacement of all functional V segments with a single human V segment, wherein the non-human immunoglobulin heavy chain locus is incapable of rearrangement to form a heavy chain variable gene that is derived from a V segment other than the single human V segment.

In one embodiment, the single human V segment is $V_H1$-69. In one embodiment, the single human V segment is $V_H1$-2.

In one embodiment, the locus comprises at least one human or non-human $D_H$ segment, and one human or non-human $J_H$ segment. In a specific embodiment, the locus comprises a human $D_H$ segment and a human $J_H$ segment. In a specific embodiment, the locus comprises a human $J_H$ segment. In another specific embodiment, the locus comprises a human $V_H1$-69, all functional human $D_H$ segments, and all functional human $J_H$ segments. In one embodiment, the human V, D, and J segments (or V and J segments) are operably linked to a mouse constant region gene at an endogenous mouse heavy chain locus. In a specific embodiment, the mouse heavy chain locus comprises a wild-type repertoire of mouse immunoglobulin constant region sequences.

In one aspect, a genetically modified non-human animal is provided, wherein the only functional immunoglobulin heavy chain V gene segment of the non-human animal is selected from a human $V_H1$-2, $V_H1$-3, $V_H1$-8, $V_H1$-18, $V_H1$-24, $V_H1$-45, $V_H1$-46, $V_H1$-58, $V_H1$-69, $V_H2$-5, $V_H2$-26, $V_H2$-70, $V_H3$-7, $V_H3$-9, $V_H3$-11, $V_H3$-13, $V_H3$-15, $V_H3$-16, $V_H3$-20, $V_H3$-21, $V_H3$-23, $V_H3$-30, $V_H3$-30-3, $V_H3$-30-5, $V_H3$-33, $V_H3$-35, $V_H3$-38, $V_H3$-43, $V_H3$-48, $V_H3$-49, $V_H3$-53, $V_H3$-64, $V_H3$-66, $V_H3$-72, $V_H3$-73, $V_H3$-74, $V_H4$-4, $V_H4$-28, $V_H4$-30-1, $V_H4$-30-2, $V_H4$-30-4, $V_H4$-31, $V_H4$-34, $V_H4$-39, $V_H4$-59, $V_H4$-61, $V_H5$-51, $V_H6$-1, $V_H7$-4-1, and a $V_H7$-81 segment. In one embodiment, the heavy chain V gene segment is a human $V_H1$-69 gene segment. In one embodiment, the heavy chain V gene segment is a human $V_H1$-2 gene segment.

In one aspect, a genetically modified non-human animal is provided, wherein the non-human animal comprises a single functional human $V_H$ segment, and wherein the non-human animal is substantially incapable of forming a rearranged immunoglobulin heavy chain variable domain gene that lacks the single functional human $V_H$ segment.

In one aspect, a genetically modified non-human animal is provided, wherein the only immunoglobulin heavy chain variable region expressed in the non-human animal is derived from one of a human segment selected from a human $V_H1$-2, $V_H1$-3, $V_H1$-8, $V_H1$-18, $V_H1$-24, $V_H1$-45, $V_H1$-46, $V_H1$-58, $V_H1$-69, $V_H2$-5, $V_H2$-26, $V_H2$-70, $V_H3$-7, $V_H3$-9, $V_H3$-11, $V_H3$-13, $V_H3$-15, $V_H3$-16, $V_H3$-20, $V_H3$-21, $V_H3$-23, $V_H3$-30, $V_H3$-30-3, $V_H3$-30-5, $V_H3$-33, $V_H3$-35, $V_H3$-38, $V_H3$-43, $V_H3$-48, $V_H3$-49, $V_H3$-53, $V_H3$-64, $V_H3$-66, $V_H3$-72, $V_H3$-73, $V_H3$-74, $V_H4$-4, $V_H4$-28, $V_H4$-30-1, $V_H4$-30-2, $V_H4$-30-4, $V_H4$-31, $V_H4$-34, $V_H4$-39, $V_H4$-59, $V_H4$-61, $V_H5$-51, $V_H6$-1, $V_H7$-4-1, and a $V_H7$-81 gene segment. In one embodiment, the human segment is a $V_H1$-69 segment. In one embodiment, the human segment is a $V_H1$-2 segment. In one embodiment, the only immunoglobulin heavy chain variable region expressed by the mouse is derived from a single V segment family member, and in one embodiment the only immunoglobulin heavy chain variable region is derived from a polymorphic variant of the single V segment family member.

In one aspect, a non-human animal comprising a restricted immunoglobulin heavy chain V gene segment repertoire is provided, wherein the non-human animal further comprises one or more human immunoglobulin κ light chain variable segments (Vκ). In one embodiment, the one or more Vκ segments are operably linked to one or more human J segments. In a specific embodiment, the J segments are human Jκ segments. In another specific embodiment, the non-human animal does not express an immunoglobulin λ light chain. In another specific embodiment, the non-human animal does not comprise a functional human or functional endogenous immunoglobulin λ light chain variable locus.

In one embodiment, the non-human animal is a mouse.

In one embodiment, the non-human animal comprises a replacement at the endogenous non-human immunoglobulin Vκ locus of all or substantially all functional endogenous Vκ segments with one or more functional human Vκ segments. In a further specific embodiment, the replacement is with all or substantially all functional human immunoglobulin Vκ segments.

In one embodiment, the non-human animal comprises a replacement at the endogenous non-human immunoglobulin Jκ locus of all or substantially all functional endogenous non-human immunoglobulin Jκ segments with one or more functional human immunoglobulin Jκ segments. In a further specific embodiment, the replacement is with all or substantially all functional human immunoglobulin Jκ segments.

In a specific embodiment, the non-human animal comprises an immunoglobulin heavy chain variable region locus that comprises a repertoire of V segments consisting essentially of a single V segment and/or polymorphic variants thereof. In one embodiment, the single immunoglobulin heavy chain V segment is a human $V_H1$-69 segment, and the non-human animal further comprises a replacement of all functional non-human $D_H$ segments with all functional human $D_H$ segments, and further comprises a replacement of all functional non-human $J_H$ segments with all functional human $J_H$ segments, and wherein the immunoglobulin heavy chain variable region locus is operably linked to a human or non-human constant region gene sequence. In a specific embodiment, the constant region gene sequence is an endogenous non-human constant region gene sequence. In a specific embodiment, the non-human animal rearranges segments at the non-human immunoglobulin heavy chain locus to form a gene encoding heavy chain variable region comprising a human $V_H1$-69 sequence, a human $D_H$ sequence, a human $J_H$ sequence, and a mouse constant region sequence.

In a specific embodiment, the non-human animal comprises an immunoglobulin heavy chain variable region locus that comprises a repertoire of V segments consisting essentially of a single V segment and/or polymorphic variants thereof. In one embodiment, the single immunoglobulin heavy chain V segment is a human $V_H1$-2 segment, and the non-human animal further comprises a replacement of all functional non-human $D_H$ segments with all functional human $D_H$ segments, and further comprises a replacement of all functional non-human $J_H$ segments with all functional human $J_H$ segments, and wherein the immunoglobulin heavy chain variable region locus is operably linked to a human or non-human constant region gene sequence. In a specific embodiment, the constant region gene sequence is an endogenous non-human constant region gene sequence. In a specific embodiment, the non-human animal rearranges segments at the non-human immunoglobulin heavy chain locus to form a gene encoding heavy chain variable region comprising a human $V_H1$-2 sequence, a human $D_H$ sequence, a human $J_H$ sequence, and a mouse constant region sequence.

In one embodiment, a B cell is provided that comprises the rearranged gene. In a specific embodiment, the B cell is from a mouse as described that has been immunized with an antigen of interest, and the B cell encodes an antibody that specifically binds the antigen of interest. In one embodiment, the antigen of interest is a pathogen. In a specific embodiment, the pathogen is selected from an influenza virus, a hepatitis virus (e.g., hepatitis B or hepatitis C virus), and a human immunodeficiency virus. In a specific embodiment, the B cell encodes a somatically mutated, high affinity (e.g., about $10^{-9}$ $K_D$ or lower) antibody comprising a human light chain variable region (e.g., a human κ light chain variable region) that specifically binds the antigen of interest.

In one aspect, a non-human animal comprising a restricted immunoglobulin heavy chain V segment repertoire is provided, wherein the non-human animal comprises one or more human λ light chain variable (Vλ) segments. In one embodiment, the one or more human Vλ segments are operably linked to one or more human J segments. In a specific embodiment, the J segments are human Jλ segments. In another specific embodiment, the non-human animal does not express a κ light chain. In another specific embodiment, the non-human animal does not comprise a functional human or non-human κ light chain variable locus.

In one embodiment, the non-human animal comprises a replacement of all or substantially all functional non-human immunoglobulin Vλ segments with one or more functional human immunoglobulin Vλ segments. In a further specific embodiment, the replacement is with all or substantially all functional human immunoglobulin Vλ segments.

In one embodiment, the non-human animal comprises a replacement of all or substantially all functional non-human immunoglobulin Jλ segments with one or more functional human immunoglobulin Jλ segments. In a further specific embodiment, the replacement is with all or substantially all functional human immunoglobulin Jλ segments.

In a specific embodiment, the non-human animal comprises an immunoglobulin heavy chain variable ($V_H$) region locus that comprises only a single $V_H$ segment, wherein the single $V_H$ segment is a human $V_H1$-69 segment or a human $V_H1$-2 segment, and further comprises a replacement of all functional non-human $D_H$ segments with all functional human $D_H$ segments, and further comprises a replacement of all functional non-human $J_H$ segments with all functional human $J_H$ segments, and wherein the $V_H$ region locus is operably linked to a human or non-human constant region gene sequence. In a specific embodiment, the constant region gene sequence is a non-human constant region gene sequence, e.g., an endogenous non-human constant gene sequence. In a specific embodiment, the non-human animal rearranges segments at the non-human immunoglobulin heavy chain locus to form a gene encoding an immunoglobulin heavy chain variable region comprising a human $V_H1$-69 sequence (or a human $V_H1$-2 sequence), a human $D_H$ sequence, a human $J_H$ sequence, and an endogenous non-human constant region sequence.

In one embodiment, a B cell is provided that comprises the rearranged gene. In a specific embodiment, the B cell is from a non-human animal as described that has been immunized with an antigen of interest, and the B cell encodes an antibody that specifically binds the antigen of interest. In one embodiment, the antigen is a human protein selected from a ligand, a cell surface receptor and an intracellular protein. In one embodiment, the antigen of interest is a pathogen. In a specific embodiment, the pathogen is selected from an influenza virus, a hepatitis virus (e.g., hepatitis B or hepatitis C virus), and a human immunodeficiency virus. In a specific embodiment, the B cell encodes a somatically mutated, high affinity (e.g., about $10^{-9}$ $K_D$ or lower) antibody comprising a human light chain variable region (e.g., a human λ light chain variable region) that specifically binds the antigen of interest.

In one aspect, a non-human animal comprising a restricted immunoglobulin heavy chain V segment repertoire is provided, wherein the non-human animal comprises a human $V_H1$-69 segment (or a human $V_H1$-2 segment) on a transgene, wherein the human $V_H1$-69 segment is operably linked on the transgene to a human or non-human $D_H$ segment, and/or a human or non-human J segment, and the transgene further comprises a human or non-human constant region gene, or a chimeric human/non-human constant region (e.g., a $C_H1$, hinge, $C_H2$, $C_H3$ or combination thereof wherein at least one sequence is non-human, e.g., selected from hinge, $C_H2$, and $C_H3$ and/or hinge). In one embodiment, the non-human animal is a mouse or rat and the non-human D, J, and/or constant region gene is a mouse or rat gene or chimeric human/mouse or rat.

In one embodiment, the non-human animal comprises a transgene that comprises an immunoglobulin light chain variable region locus that comprises one or more human immunoglobulin Vλ segments and Jλ segments, or one or more human immunoglobulin Vκ segments and Jκ segments, and a human immunoglobulin κ or λ light chain constant region gene, such that the transgene rearranges in the non-human animal to form a rearranged immunoglobulin κ or λ light chain gene.

In a specific embodiment, the non-human animal comprises a transgene having an immunoglobulin heavy chain variable locus that comprises a single V segment that is a human $V_H1$-69 segment (or a human $V_H1$-2 segment), one or more human D segments, one or more human J segments, and a human constant gene operably linked to the heavy chain variable locus, such that the mouse expresses from the transgene a fully human antibody derived from the $V_H1$-69 segment (or the $V_H1$-2 segment). In one embodiment, the non-human animal does not comprise a functional endogenous immunoglobulin heavy chain variable region locus. In a specific embodiment, the non-human animal comprises a nonfunctional endogenous immunoglobulin heavy chain variable region locus that comprises a deletion of an endogenous non-human $D_H$ and/or endogenous non-human $J_H$ segment, such that the non-human animal is incapable of rearranging the endogenous immunoglobulin heavy chain variable region locus to form a rearranged non-human antibody gene. In a specific embodiment, the non-human animal comprises a deletion of a switch sequence operably linked to an endogenous mouse heavy chain constant region. In a specific embodiment, the switch sequence is a non-human (e.g., mouse) μ switch sequence. In another embodiment, the non-human animal further comprises a lack of a functional endogenous light chain variable locus selected from an immunoglobulin κ locus and an immunoglobulin λ locus. In a specific embodiment, the non-human animal comprises a deletion of a Jκ and/or a Jλ sequence, such that the non-human animal is incapable of rearranging an endogenous non-human immunoglobulin κ light chain and/or an endogenous non-human immunoglobulin λ light chain variable region to form a rearranged endogenous non-human immunoglobulin κ light chain and/or a rearranged endogenous non-human immunoglobulin λ light chain gene.

In one embodiment, the non-human animal comprises a deletion of an endogenous non-human immunoglobulin κ light chain sequence that results in a functional knockout of the endogenous non-human immunoglobulin κ light chain. In one embodiment, the non-human animal comprises a deletion of an endogenous non-human immunoglobulin λ light chain sequence that results in a functional knockout of the endogenous non-human immunoglobulin λ light chain.

In one aspect, a rodent is provided that comprises an immunoglobulin heavy chain variable repertoire derived from no more than one human $V_H$ segment or one or more polymorphs thereof, from a D segment selected from a repertoire of one or more D segments, and from a J segment selected from a repertoire of one or more J segments; wherein the rodent comprises an ectopic ADAM6 sequence or ortholog or homolog or fragment thereof that is functional in a male rodent.

In one embodiment, the human $V_H$ segment is present in 1, 2, 3, 4, 5, 6, 7, 8, 9, or 10 or more polymorphic variants, wherein each polymorphic variant is operably linked to a D and/or J segment such that each polymorphic variant is capable of rearranging and forming a rearranged heavy chain variable domain with any of the one or more D segments and any of the one or more J segments. In one embodiment, the rodent is a mouse or a rat. In one embodiment, the repertoire of D segments comprises two or more D segments. In one embodiment, the repertoire of J segments comprises two or more J segments. In one embodiment, the D and/or J segments are human segments. In one embodiment, the ectopic ADAM6 sequence is an ADAM6 sequence of a wild-type rodent of the same species. In one embodiment, the rodent is a mouse or a rat. In one embodiment, the ectopic ADAM6 sequence or ortholog or homolog or fragment thereof that is functional in the male rodent is on the same chromosome as the modified immunoglobulin heavy chain variable repertoire; in one embodiment, it is on a different chromosome.

In one aspect, a nucleotide construct is provided that comprises a sequence encoding a single human immunoglobulin heavy chain $V_H$ segment and/or polymorphic variants thereof and one or more $D_H$ and one or more J sequences, wherein the construct comprises at least one homology arm homologous to a non-human immunoglobulin heavy chain variable locus, or a recombinase recognition site (e.g., a lox site). In one embodiment, the V segment is a $V_H1$-69 segment or a $V_H1$-2 segment.

In one aspect, a nucleotide construct is provided, comprising a nucleotide sequence encoding a single human immunoglobulin heavy chain V segment, wherein the single $V_H$ segment is a $V_H1$-69 (or $V_H1$-2) segment. In one embodiment, the construct comprises a site-specific recombinase recognition site. In one embodiment, the construct comprises a first mouse homology arm upstream of the $V_H1$-69 (or $V_H1$-2) segment and a second mouse homology arm downstream of the $V_H1$-69 (or $V_H1$-2) segment, and wherein the first mouse homology arm is homologous to a region of a mouse chromosome immediately upstream of a mouse immunoglobulin heavy chain variable region but not including a functional mouse immunoglobulin heavy chain variable segment. In one embodiment, the construct comprises SEQ ID NO: 6. In one embodiment, the construct comprises SEQ ID NO: 74. In one embodiment, the construct comprises SEQ ID NO: 75. In one embodiment, the construct comprises SEQ ID NO: 76.

In one aspect, the restricted single $V_H$ segment is in a non-human animal, or the restricted $V_H$ segment is at a non-human immunoglobulin heavy chain locus (e.g., in situ or in a transgene), and the non-human animal or non-human immunoglobulin heavy chain locus is selected from a mouse, rat, rabbit, pig, bovine (e.g., cow, bull, buffalo), deer, sheep, goat, chicken, cat, dog, ferret, primate (e.g., marmoset, rhesus monkey) locus or animal. In a specific embodiment, the non-human animal or locus is a mouse or a rat locus.

In one aspect, a targeting vector is provided, comprising (a) a nucleotide sequence that is identical or substantially identical to a human variable region gene segment nucleotide sequence; and, (b) a nucleotide sequence encoding a mouse ADAM6 or ortholog or homolog or fragment thereof that is functional in a mouse.

In one embodiment, the targeting vector further comprises a promoter operably linked to the sequence encoding the mouse ADAM6. In a specific embodiment, the promoter is a mouse ADAM6 promoter.

In one aspect, a nucleotide construct for modifying a mouse immunoglobulin heavy chain variable locus is provided, wherein the construct comprises at least one site-specific recombinase recognition site and a sequence encoding an ADAM6 protein or ortholog or homolog or fragment thereof that is functional in a mouse.

In one aspect, a nucleic acid construct is provided, comprising an upstream homology arm and a downstream homology arm, wherein the upstream homology arm comprises a sequence that is identical or substantially identical to a human immunoglobulin heavy chain variable region sequence, the downstream homology arm comprises a sequence that is identical or substantially identical to a human or mouse immunoglobulin variable region sequence, and disposed between the upstream and downstream homology arms is a sequence that comprises a nucleotide sequence encoding a mouse ADAM6 protein. In a specific embodiment, the sequence encoding the mouse ADAM6 gene is operably linked with a mouse promoter with which the mouse ADAM6 is linked in a wild type mouse.

In one aspect, a cell isolated from a genetically modified mouse as described herein is provided. In one embodiment, the cell is a lymphocyte. In one embodiment, the lymphocyte is a B cell. In a specific embodiment, the B cell comprises an ectopic ADAM6 sequence or ortholog or homolog or sequence encoding a functional fragment thereof, wherein the B cell expresses a heavy chain variable domain derived from a human $V_H$ gene segment.

In one aspect, a cell or tissue is provided, wherein the cell or tissue is derived from a non-human animal as described herein, and comprises a restricted $V_H$ segment repertoire. In one embodiment, the $V_H$ segment repertoire is restricted to a single $V_H$ segment family member and/or polymorphic variants thereof. In a specific embodiment, the single $V_H$ segment is a human $V_H1$-69 segment or a human $V_H1$-2 segment. In one embodiment, the cell or tissue is derived from spleen, lymph node or bone marrow of the non-human animal.

In one embodiment, the cell is an ES cell. In one embodiment, the cell is a B cell. In one embodiment, the cell is a germ cell.

In one embodiment, the tissue is selected from connective, muscle, nervous and epithelial tissue. In a specific embodiment, the tissue is reproductive tissue.

In one embodiment, the cell and/or tissue derived from a mouse as described herein is isolated for use in one or more ex vivo assays. In various embodiments, the one or more ex vivo assays include measurements of physical, thermal, electrical, mechanical or optical properties, a surgical procedure, measurements of interactions of different tissue types, the development of imaging techniques, or a combination thereof.

In one embodiment, the non-human animal is a mouse.

In one aspect, a non-human embryo is provided comprising a restricted heavy chain $V_H$ segments as described herein. In one embodiment, the embryo comprises an ES donor cell that comprises the restricted $V_H$ segment, and host embryo cells.

In one embodiment, the non-human animal is a mouse.

In one aspect, a non-human cell comprising a chromosome or fragment thereof of a non-human animal as described herein. In one embodiment, the non-human cell comprises a nucleus of a non-human animal as described herein. In one embodiment, the non-human cell comprises the chromosome or fragment thereof as the result of a nuclear transfer.

In one aspect, a nucleus derived from a non-human animal as described herein is provided. In one embodiment, the nucleus is from a diploid cell that is not a B cell.

In one aspect, a pluripotent, induced pluripotent, or totipotent cell derived from a non-human animal as described herein is provided. In a specific embodiment, the cell is a mouse embryonic stem (ES) cell.

In one aspect, a non-human induced pluripotent cell comprising a restricted $V_H$ segment repertoire is provided. In one embodiment, the induced pluripotent cell is derived from a non-human animal as described herein.

In one aspect a hybridoma is provided, comprising a sequence of a lymphocyte of a mouse as described herein. In one embodiment, the lymphocyte is a B cell.

In one aspect, a hybridoma or quadroma is provided, derived from a cell of a non-human animal as described herein. In one embodiment, the non-human animal is a mouse or rat.

In one aspect, mouse cells and mouse embryos are provided, including but not limited to ES cells, pluripotent cells, and induced pluripotent cells, that comprise genetic modifications as described herein. Cells that are XX and cells that are XY are provided. Cells that comprise a nucleus containing a modification as described herein are also provided, e.g., a modification introduced into a cell by pronuclear injection. Cells, embryos, and mice that comprise a virally introduced ADAM6 gene are also provided, e.g., cells, embryos, and mice comprising a transduction construct comprising an ADAM6 gene that is functional in the mouse.

In one aspect, a genetically modified mouse cell is provided, wherein the cell is incapable of expressing a heavy chain comprising rearranged endogenous immunoglobulin heavy chain gene segments, and the cell comprises a functional ADAM6 gene that encodes a mouse ADAM6 protein or functional fragment thereof. In one embodiment, the cell further comprises an insertion of human immunoglobulin gene segments. In a specific embodiment, the human immunoglobulin gene segments are heavy chain gene segments that are operably linked to mouse heavy chain constant regions such that upon rearrangement encode a functional heavy chain of an antibody that comprises a human variable region.

In one aspect, a genetically modified mouse cell is provided; wherein the cell lacks a functional endogenous mouse ADAM6 locus, and the cell comprises an ectopic nucleotide sequence that encodes a mouse ADAM6 protein or functional fragment thereof. In one embodiment, the cell further comprises a modification of an endogenous immunoglobulin heavy chain variable gene sequence. In a specific embodiment, the modification of the endogenous immunoglobulin heavy chain variable gene sequence comprises a deletion selected from a deletion of a mouse $V_H$ gene segment, a deletion of a mouse $D_H$ gene segment, a deletion of a mouse $J_H$ gene segment, and a combination thereof. In a specific embodiment, the mouse comprises a replacement of one or more mouse immunoglobulin $V_H$, $D_H$, and/or $J_H$ sequences with a human immunoglobulin sequence. In a specific embodiment, the human immunoglobulin sequence is selected from a human $V_H$, a human $V_L$, a human $D_H$, a human $J_H$, a human $J_L$, and a combination thereof.

In one embodiment, the cell is a totipotent cell, a pluripotent cell, or an induced pluripotent cell. In a specific embodiment, the cell is a mouse ES cell.

In one aspect, a mouse B cell is provided, wherein the mouse B cell comprises a rearranged immunoglobulin heavy chain gene, wherein the B cell comprises on a chromosome of the B cell a nucleic acid sequence encoding an ADAM6 protein or ortholog or homolog or fragment thereof that is functional in a male mouse. In one embodiment, the mouse B cell comprises two alleles of the nucleic acid sequence.

In one embodiment, the nucleic acid sequence is on a nucleic acid molecule (e.g., a B cell chromosome) that is contiguous with the rearranged mouse immunoglobulin heavy chain locus.

In one embodiment, the nucleic acid sequence is on a nucleic acid molecule (e.g., a B cell chromosome) that is distinct from the nucleic acid molecule that comprises the rearranged mouse immunoglobulin heavy chain locus.

In one embodiment, the mouse B cell comprises a rearranged non-mouse immunoglobulin variable gene sequence operably linked to a mouse or human immunoglobulin constant region gene, wherein the B cell comprises a nucleic acid sequence that encodes an ADAM6 protein or ortholog or homolog or fragment thereof that is functional in a male mouse.

In one embodiment, the nucleic acid sequence is on a nucleic acid molecule (e.g., a B cell chromosome) that is located at or within the nearest gene locus with respect to the rearranged non-human immunoglobulin variable gene sequence.

In one embodiment, the nucleic acid sequence is on a nucleic acid molecule (e.g., a B cell chromosome) that is contiguous with the rearranged non-human immunoglobulin variable region sequence.

In one aspect, a somatic mouse cell is provided, comprising a chromosome that comprises a modified immunoglobulin heavy chain locus, and a nucleic acid sequence encoding a mouse ADAM6 or ortholog or homolog or fragment thereof that is functional in a male mouse. In one embodiment, the nucleic acid sequence is on the same chromosome as the modified immunoglobulin heavy chain locus. In one embodiment, the nucleic acid is on a different chromosome than the modified immunoglobulin heavy chain locus. In one embodiment, the somatic cell comprises a single copy of the nucleic acid sequence. In one embodiment, the somatic cell comprises at least two copies of the nucleic acid sequence. In a specific embodiment, the somatic cell is a B cell. In a specific embodiment, the cell is a germ cell. In a specific embodiment, the cell is a stem cell.

In one aspect, a mouse germ cell is provided, comprising a nucleic acid sequence encoding a mouse ADAM6 (or homolog or ortholog or functional fragment thereof) on a chromosome of the germ cell, wherein the nucleic acid sequence encoding the mouse ADAM6 (or homolog or ortholog or functional fragment thereof) is at a position in the chromosome that is different from a position in a chromosome of a wild-type mouse germ cell. In one embodiment, the nucleic acid sequence is at a mouse immunoglobulin locus. In one embodiment, the nucleic acid sequence is on the same chromosome of the germ cell as a mouse immunoglobulin locus. In one embodiment, the nucleic acid sequence is on a different chromosome of the germ cell than the mouse immunoglobulin locus. In one embodiment, the mouse immunoglobulin locus comprises a replacement of at least one mouse immunoglobulin sequence with at least one non-mouse immunoglobulin sequence. In a specific embodiment, the at least one non-mouse immunoglobulin sequence is a human immunoglobulin sequence. In one embodiment, the human immunoglobulin sequence is an immunoglobulin heavy chain sequence.

In one aspect, an antibody variable domain sequence made in a non-human animal as described herein is provided.

In one aspect, a human therapeutic is provided, comprising an antibody variable domain comprising a sequence derived from a non-human animal as described herein.

In one aspect, a method of obtaining an antibody variable region sequence from a non-human animal is provided, wherein the antibody variable region sequence is derived from a human $V_H1$-69 segment or a $V_H1$-2 segment, wherein the method comprises (a) immunizing a non-human animal with an antigen of interest, wherein the non-human animal comprises a replacement at the endogenous immunoglobulin heavy chain locus of all or substantially all non-human variable segments with a single human variable segment, wherein the single human variable segment is a $V_H1$-69 segment or a $V_H1$-2 segment, and wherein the non-human animal is substantially incapable of forming a immunoglobulin heavy chain variable region sequence that is not derived from a human $V_H1$-69 segment or a $V_H1$-2 segment; (b) allowing the non-human animal to mount an immune response with respect to the antigen of interest; and, (c) identifying or isolating an immunoglobulin heavy chain variable region sequence of the non-human animal, wherein the antibody binds the antigen of interest.

In one embodiment, the single human variable segment is a $V_H1$-69 segment.

In one embodiment, the antibody variable region sequence is derived from SEQ ID NO: 37. In one embodiment, the antibody variable region sequence is at least 75%, at least 80%, at least 85%, at least 90%, at least 95%, or at least 98% identical to SEQ ID NO: 37. In one embodiment, the antibody variable region sequence comprises SEQ ID NO: 37.

In one embodiment the single human variable segment is a $V_H1$-2 segment.

In one embodiment, the antibody variable region sequence is derived from SEQ ID NO: 63. In one embodiment, the antibody variable region sequence is at least 75%, at least 80%, at least 85%, at least 90%, at least 95%, or at least 98% identical to SEQ ID NO: 63. In one embodiment, the antibody variable region sequence comprises SEQ ID NO: 63.

In one aspect, a method for generating a repertoire of human antibody variable regions in a non-human animal is provided, wherein the human heavy chain variable regions of the repertoire are derived from the same $V_H$ gene family member and one of a plurality of $D_H$ segments and one of a plurality of $J_H$ segments, wherein the repertoire is characterized by having heavy chain immunoglobulin FR1 (framework 1), CDR1, FR2, CDR2, and FR3 sequences from a single $V_H$ gene family member. In one embodiment, the repertoire is further characterized by having a plurality of different CDR3+FR4 sequences.

In one embodiment, the single $V_H$ gene family is selected from $V_H$ family 1, 2, 3, 4, 5, 6, and 7. In a specific embodiment, the single $V_H$ gene family is $V_H$ family 1. In one embodiment, the single $V_H$ gene family member is selected from $V_H1$-2, $V_H1$-69, $V_H2$-26, $V_H2$-70, and $V_H3$-23. In a specific embodiment, the single $V_H$ gene family member is $V_H1$-69.

In one embodiment, the repertoire comprises heavy chain FR1, CDR1, FR2, CDR2 and FR3 sequences derived from a $V_H1$-69 segment. In a specific embodiment, the repertoire comprises heavy chain FR1, CDR1, FR2, CDR2 and FR3 sequences derived from SEQ ID NO: 38. In a specific embodiment, the repertoire comprises heavy chain FR1, CDR1, FR2, CDR2 and FR3 sequences of SEQ ID NO: 38.

In one embodiment, the repertoire comprises heavy chain FR1, CDR1, FR2, CDR2 and FR3 sequences derived from a $V_H1$-2 segment. In a specific embodiment, the repertoire comprises heavy chain FR1, CDR1, FR2, CDR2 and FR3 sequences derived from SEQ ID NO: 64. In a specific embodiment, the repertoire comprises heavy chain FR1, CDR1, FR2, CDR2 and FR3 sequences of SEQ ID NO: 64.

In one aspect, a method for generating a plurality of different CDR3 and FR4 sequences in a non-human animal is provided, comprising exposing a non-human animal that comprises an immunoglobulin heavy chain variable gene locus with a $V_H$ segment repertoire restricted to a single $V_H$ segment family member to an antigen of interest, allowing the non-human animal to develop an immune response to the antigen, wherein the immune response generates a B cell repertoire whose heavy chain variable domains are each derived from the single $V_H$ segment family member and that comprise a plurality of different CDR3 and FR4 sequences.

In one embodiment, the singe $V_H$ segment family member is human. In one embodiment, the non-human animal is selected from a mouse, a rat, and a rabbit. In one embodiment, the antigen of interest is selected from a ligand, a receptor, an intracellular protein and a secreted protein. In one embodiment, the antigen of interest is a human pathogen.

In one aspect, a nucleotide sequence encoding an immunoglobulin variable region made in a non-human animal as described herein is provided.

In one aspect, an immunoglobulin heavy chain or immunoglobulin light chain variable region amino acid sequence of an antibody made in a non-human animal as described herein is provided.

In one aspect, an immunoglobulin heavy chain or immunoglobulin light chain variable region nucleotide sequence encoding a variable region of an antibody made in a non-human as described herein is provided.

In one aspect, an antibody or antigen-binding fragment thereof (e.g., Fab, F(ab)$_2$, scFv) made in a non-human animal as described herein is provided.

In one aspect, a method for making a genetically modified non-human animal is provided, comprising replacing one or more immunoglobulin heavy chain gene segments upstream (with respect to transcription of the immunoglobulin heavy chain gene segments) of an endogenous ADAM6 locus of the non-human animal with one or more human immunoglobulin heavy chain gene segments, and replacing one or more immunoglobulin gene segments downstream (with respect to transcription of the immunoglobulin heavy chain gene segments) of the ADAM6 locus of the non-human animal with one or more human immunoglobulin heavy chain or light chain gene segments. In one embodiment, the one or more human immunoglobulin gene segments replacing one or more endogenous immunoglobulin gene segments upstream of an endogenous ADAM6 locus of the non-human animal include V gene segments. In one embodiment, the human immunoglobulin gene segments replacing one or more endogenous immunoglobulin gene segments upstream of an endogenous ADAM6 locus of the non-human animal include V and D gene segments. In one embodiment, the one or more human immunoglobulin gene segments replacing one or more endogenous immunoglobulin gene segments downstream of an endogenous ADAM6 locus of the non-human animal include J gene segments. In one embodiment, the one or more human immunoglobulin gene segments replacing one or more endogenous immunoglobulin gene segments downstream of an endogenous ADAM6 locus of the non-human animal include D and J gene segments. In one embodiment, the one or more human immunoglobulin gene segments replacing one or more endogenous immunoglobulin gene segments downstream of an endogenous ADAM6 locus of the non-human animal include V, D and J gene segments. In a specific embodiment, the one or more gene segments replacing one or more endogenous immunoglobulin gene segments downstream of an endogenous ADAM6 locus of the non-human animal includes a single V gene segment, one or more D gene segments and one or more J gene segments.

In one embodiment, the one or more immunoglobulin heavy chain gene segments upstream and/or downstream of the ADAM6 gene are replaced in a pluripotent, induced pluripotent, or totipotent cell to form a genetically modified progenitor cell; the genetically modified progenitor cell is introduced into a host; and, the host comprising the genetically modified progenitor cell is gestated to form a non-human animal comprising a genome derived from the genetically modified progenitor cell. In one embodiment, the host is an embryo. In a specific embodiment, the host is selected from a mouse pre-morula (e.g., 8- or 4-cell stage), a tetraploid embryo, an aggregate of embryonic cells, or a blastocyst.

In one aspect, a non-human animal is provided, wherein the non-human animal has a B cell repertoire that expresses immunoglobulin heavy chain variable domains derived from a single V segment family member. In one embodiment, at least 10%, at least 20%, at least 30%, at least 40%, at least 50%, at least 60%, at least 70%, at least 80%, at least 90, or at least 95% of the B cell repertoire of the non-human animal immunoglobulin heavy chain variable domain expressed in the B cell repertoire is derived from the same V segment family member. In a specific embodiment, the percentage is at least 90%. In one embodiment, the B cell repertoire consists essentially of peripheral (blood) B cells. In one embodiment, the B cell repertoire consists essentially of splenic B cells. In one embodiment, the B cell repertoire consists essentially of bone marrow B cells. In one embodiment, the B cell repertoire consists essentially of peripheral B cells, splenic B cells, and bone marrow B cells.

In one aspect, a genetically modified non-human animal is provided, wherein more than 10%, 20%, 30%, 40%, 50%, 60%, 70%, 80%, or more than 90% of the B cells of the non-human animal that express a heavy chain immunoglobulin variable domain express a heavy chain immunoglobulin variable domain derived from a single $V_H$ gene segment family member. In one embodiment, at least 75% of the B cells of the non-human animal that express an immunoglobulin heavy chain variable domain express an immunoglobulin heavy chain variable domain derived from the single $V_H$ gene segment family member. In a specific embodiment, the percentage is at least 90%. In one embodiment, all of the B cells that express a heavy chain domain that is derived from the single $V_H$ gene family member.

In one aspect, a genetically modified mouse is provided that makes an antigen-specific B cell population in response to immunization with an antigen of interest, wherein at least 10%, 20%, 30%, 40%, 50%, 60%, 70%, 80%, or more than 90%, of said antigen-specific B cell population expresses immunoglobulin heavy chains that are all derived from the same $V_H$ gene segment. In one embodiment, at least 75% of the antigen-specific B cell population expresses immunoglobulin heavy chains derived from the same $V_H$ gene segment. In one embodiment, all of the antigen-specific B cells express a heavy chain that is derived from the same $V_H$ gene segment.

In one aspect, a non-human animal comprising a restricted $V_H$ gene segment repertoire is provided, wherein the restriction is to a human $V_H1$-69 gene segment or a $V_H1$-69 gene segment that is at least about 75.5%, 76.5%, 86.7%, 87.8%, 94.9%, 96.9%, 98%, or 99% identical to a $V_H1$-69*01 gene segment. In a specific embodiment, the restricted repertoire is selected from one or more of the $V_H1$-69 variants of FIG. 7.

In one aspect, a non-human animal comprising a restricted $V_H$ gene segment repertoire is provided, wherein the restriction is to a human $V_H1$-2 gene segment or a $V_H1$-2 gene segment that is at least about 94.9%, 95.9%, 96.9%, 98%, or 99% identical to a $V_H1$-2 gene segment. In a specific embodiment, the restricted repertoire is selected from one or more of the $V_H1$-2 variants of FIG. 10.

In one embodiment, the non-human animal is a mouse.

In one aspect, a non-human animal comprising a restricted human $V_H$ segment repertoire is provided, further comprising a humanized immunoglobulin light chain variable segment locus, wherein the ratio of λ to κ light chains expressed in the mouse is about the same as in a wild-type mouse.

In one aspect, a non-human animal is provided, comprising a restricted immunoglobulin heavy chain locus characterized by the presence of a single $V_H$ gene segment, one or more $D_H$ gene segments, and one or more $J_H$ gene segments, wherein the single $V_H$ gene segment is a polymorphic $V_H$ gene segment.

In one embodiment, the polymorphic $V_H$ gene segment is a human $V_H$ gene segment that is associated with a high copy number in human populations. In one embodiment, the human $V_H$ gene segment is selected from $V_H1$-2, $V_H1$-69, $V_H2$-26, $V_H2$-70, $V_H3$-23, or a polymorphic variant thereof. In a specific embodiment, the human $V_H$ gene segment is a $V_H1$-69 gene segment. In another specific embodiment, the human VH gene segment is a $V_H1$-2 gene segment.

In one embodiment, the single $V_H$ gene segment is operably linked to a human, mouse, or chimeric human/mouse immunoglobulin constant region gene. In a specific embodiment, the immunoglobulin constant region gene is a mouse constant region gene. In one embodiment, the immunoglobulin constant gene comprises a human sequence selected from a human $C_H1$, a human hinge, a human $C_H2$, a human $C_H3$, and a combination thereof. In one embodiment, the mouse constant gene is at an endogenous immunoglobulin heavy chain locus.

In one embodiment, the non-human animal further comprises a human immunoglobulin $V_L$ gene segment operably linked to a J gene segment and a light chain constant gene. In a specific embodiment, the $V_L$ gene segment and/or the J gene segment are selected from a human κ gene segment and a human λ gene segment. In one embodiment, the $V_L$ and/or J gene segments are human κ gene segments.

In various embodiments, the non-human animal comprises a deletion of all or substantially all endogenous $V_H$ gene segments.

In various embodiments, the non-human animal comprises an inactivated endogenous heavy chain variable gene locus. In various embodiments, the inactivated endogenous heavy chain variable gene locus is not operably linked to an endogenous heavy chain constant region gene.

In one aspect, a non-human animal is provided, wherein the non-human animal is characterized by the expression of serum immunoglobulin, wherein greater than 80% of the serum immunoglobulin comprises a human heavy chain variable domain and a cognate human light chain variable domain, wherein the human heavy chain variable domain is derived from a $V_H$ gene segment repertoire consisting essentially of a single human $V_H$ gene segment and/or polymorphic variants thereof.

In one embodiment, the single human $V_H$ gene segment is a human $V_H$1-69 gene segment and/or polymorphic variants thereof. In one embodiment, the single human $V_H$ gene segment is a human $V_H$1-2 gene segment and/or polymorphic variants thereof.

In one aspect, a non-human animal is provided, comprising, in its germline, a replacement at an endogenous immunoglobulin heavy chain locus of all or substantially all endogenous $V_H$ gene segments with a single human $V_H$ gene segment and/or polymorphic variants thereof.

In one embodiment, the non-human animal further comprises a replacement at an endogenous immunoglobulin light chain locus of all or substantially all endogenous $V_L$ gene segments with one or more human $V_L$ gene segments. In a specific embodiment, the mouse further comprises one or more human $J_L$ gene segments operably linked to the human $V_L$ gene segments.

In one aspect, a non-human animal that expresses an antibody that comprises at least one human variable domain/non-human constant domain immunoglobulin polypeptide is provided, wherein the non-human animal expresses a non-human ADAM6 protein or ortholog or homolog thereof from an endogenous immunoglobulin heavy chain locus. In one embodiment, the endogenous immunoglobulin heavy chain locus is incapable of rearranging to encode a functional heavy chain of an antibody.

In one aspect, a non-human animal that expresses an antibody that comprises at least one human variable domain/non-human constant domain immunoglobulin polypeptide is provided, wherein the non-human animal expresses a non-human ADAM6 protein or ortholog or homolog thereof from a locus other than an immunoglobulin locus.

In one embodiment, the ADAM6 protein or ortholog or homolog thereof is expressed in a B cell of the non-human animal, wherein the B cell comprises a rearranged immunoglobulin sequence that comprises a human variable sequence and a non-human constant sequence.

In one embodiment, the non-human constant sequence is a rodent sequence. In one embodiment, the rodent is selected from a mouse, a rat, and a hamster.

In one aspect, a method is provided for making an infertile male non-human animal, comprising rendering an endogenous ADAM6 allele of a donor ES cell nonfunctional (or knocking out said allele), introducing the donor ES cell into a host embryo, gestating the host embryo in a surrogate mother, and allowing the surrogate mother to give birth to progeny derived in whole or in part from the donor ES cell. In one embodiment, the method further comprises breeding progeny to obtain an infertile male non-human animal.

In one aspect, a method is provided for making a non-human animal with a genetic modification of interest, wherein the non-human animal is infertile, the method comprising the steps of (a) making a genetic modification of interest in a genome; (b) modifying the genome to knockout an endogenous ADAM6 allele, or render an endogenous ADAM6 allele nonfunctional; and, (c) employing the genome in making a non-human animal. In various embodiments, the genome is from an ES cell or used in a nuclear transfer experiment.

In one aspect, a non-human animal made using a targeting vector, nucleotide construct, or cell as described herein is provided.

In one aspect, a progeny of a mating of a non-human animal as described herein with a second non-human animal that is a wild-type non-human animal or genetically modified is provided.

In one aspect, a method for maintaining a non-human animal strain is provided, wherein the non-human animal strain comprises a replacement of a non-human immunoglobulin heavy chain sequence with one or more heterologous immunoglobulin heavy chain sequences. In one embodiment, the one or more heterologous immunoglobulin heavy chain sequences are human immunoglobulin heavy chain sequences.

In one embodiment, the non-human animal strain comprises a deletion of one or more non-human $V_H$, $D_H$, and/or $J_H$ gene segments. In one embodiment, the non-human animal further comprises a single human $V_H$ gene segment, one or more human $D_H$ gene segments, and/or one or more human $J_H$ gene segments. In one embodiment, the non-human animal comprises a single human $V_H$ segment, at least 27 human $D_H$ gene segments, and at least six $J_H$ gene segments. In a specific embodiment, the non-human animal comprises a single human $V_H$ segment, 27 human $D_H$ gene segments, and six human $J_H$ gene segments, wherein said single human $V_H$ gene segment, 27 human $D_H$ gene segments, and six human. $J_H$ gene segments are operably linked to a constant region gene. In one embodiment, the constant region gene is a non-human constant region gene. In one embodiment, the constant region gene comprises a mouse or rat constant region gene sequence selected from a $C_H1$, a hinge, a $C_H2$, a $C_H3$, and/or a $C_H4$ or a combination thereof. In various embodiments, the single human $V_H$ gene segment is a human $V_H$1-69 or a human $V_H$1-2 gene segment.

In one embodiment, the method comprises generating a male non-human animal heterozygous for the replacement of the non-human immunoglobulin heavy chain sequence, and breeding the heterozygous male non-human animal with a wild-type female non-human animal or a female non-human animal that is homozygous or heterozygous for the human heavy chain sequence. In one embodiment, the method comprises maintaining the non-human animal strain by repeatedly breeding heterozygous males with females that are wild type or homozygous or heterozygous for the human heavy chain sequence.

In one embodiment, the method comprises obtaining cells from male or female non-human animals homozygous or heterozygous for the human heavy chain sequence, and employing those cells as donor cells or nuclei therefrom as donor nuclei, and using the cells or nuclei to make genetically modified non-human animals using host cells and/or gestating the cells and/or nuclei in surrogate mothers.

In one embodiment, only male non-human animals that are heterozygous for the replacement at the heavy chain locus are bred to female non-human animals. In a specific embodiment, the female non-human animals are homozygous, heterozygous, or wild type with respect to a replaced heavy chain locus.

In one embodiment, the non-human animals further comprise a replacement of λ and/or κ light chain variable sequences at an endogenous immunoglobulin light chain locus with heterologous immunoglobulin light chain sequences. In one embodiment, the heterologous immunoglobulin light chain sequences are human immunoglobulin λ and/or κ light chain variable sequences.

In one embodiment, the non-human animal further comprises a transgene at a locus other than an endogenous immunoglobulin locus, wherein the transgene comprises a sequence encoding a rearranged or unrearranged heterologous λ or κ light chain sequence (e.g., unrearranged $V_L$ and unrearranged $J_L$, or rearranged $V_L J_L$) operably linked (for unrearranged) or fused (for rearranged) to an immunoglobulin light chain constant region sequence. In one embodiment, the heterologous λ or κ light chain sequence is human. In one embodiment, the constant region sequence is selected from rodent, human, and non-human primate. In one embodiment, the constant region sequence is selected from mouse, rat, and hamster. In one embodiment, the transgene comprises a non-immunoglobulin promoter that drives expression of the light chain sequences. In a specific embodiment, the promoter is a transcriptionally active promoter. In a specific embodiment, the promoter is a ROSA26 promoter.

In one aspect, a method for making a genetically modified non-human animal is provided, comprising inserting a non-human nucleotide sequence that comprises a non-human immunoglobulin gene segment in the genome of the animal for a first modification, wherein the insertion maintains an endogenous ADAM6 gene, then rendering the endogenous immunoglobulin heavy chain locus of the non-human animal non-functional for a second modification. In one embodiment, the first modification is performed upstream of an endogenous immunoglobulin heavy chain constant region gene and the second modification is performed to invert, translocate, or place out of operable linkage the endogenous immunoglobulin heavy chain locus such that the endogenous immunoglobulin heavy chain locus is incapable of rearranging to encode a functional heavy chain variable region.

In one aspect, a method for making a genetically modified non-human animal is provided, comprising replacing a non-human nucleotide sequence that comprises a non-human immunoglobulin gene segment and a non-human ADAM6 (or ortholog or homolog or fragment thereof functional in a male non-human animal) nucleotide sequence with a sequence comprising a human immunoglobulin gene segment to form a first chimeric locus, then inserting a sequence comprising a non-human ADAM6-encoding sequence (or a sequence encoding an ortholog or homolog or functional fragment thereof) into the sequence comprising the human immunoglobulin gene segment to form a second chimeric locus.

In one embodiment, the second chimeric locus comprises a human immunoglobulin heavy chain variable ($V_H$) gene segment. In one embodiment, the second chimeric locus comprises a human immunoglobulin light chain variable ($V_L$) gene segment. In a specific embodiment, the second chimeric locus comprises a human $V_H$ gene segment or a human $V_L$ gene segment operably linked to a human $D_H$ gene segment and a human $J_H$ gene segment. In a further specific embodiment, the second chimeric locus is operably linked to a third chimeric locus that comprises a human $C_H 1$ sequence, or a human $C_H 1$ and human hinge sequence, fused with a mouse $C_H 2 + C_H 3$ sequence.

In one aspect, use of a mouse that comprises an ectopic nucleotide sequence comprising a mouse ADAM6 locus or sequence to make a fertile male mouse is provided, wherein the use comprises mating the mouse comprising the ectopic nucleotide sequence that comprises the mouse ADAM6 locus or sequence to a mouse that lacks a functional endogenous mouse ADAM6 locus or sequence, and obtaining a progeny that is a female capable of producing progeny having the ectopic ADAM6 locus or sequence or that is a male that comprises the ectopic ADAM6 locus or sequence, and the male exhibits a fertility that is approximately the same as a fertility exhibited by a wild-type male mouse.

In one aspect, use of a mouse as described herein to make an immunoglobulin variable region nucleotide sequence is provided.

In one aspect, use of a mouse as described herein to make a fully human Fab or a fully human $F(ab)_2$ is provided.

In one aspect, use of a mouse as described herein to make an immortalized cell line is provided.

In one aspect, use of a mouse as described herein to make a hybridoma or quadroma is provided.

In one aspect, use of a mouse as described herein to make a phage library containing human heavy chain variable regions and human light chain variable regions is provided.

In one embodiment, the human heavy chain variable regions are derived from a human $V_H 1$-69 gene segment that comprises a sequence selected from SEQ ID NO: 37, SEQ ID NO: 39, SEQ ID NO: 40, SEQ ID NO: 41, SEQ ID NO: 43, SEQ ID NO: 45, SEQ ID NO: 47, SEQ ID NO: 49, SEQ ID NO: 51, SEQ ID NO: 53, SEQ ID NO: 55, SEQ ID NO: 57 and SEQ ID NO: 59.

In one embodiment, the human heavy chain variable regions are derived from a human $V_H 1$-69 gene segment that comprises a sequence selected from SEQ ID NO: 38, SEQ ID NO: 40, SEQ ID NO: 42, SEQ ID NO: 44, SEQ ID NO: 46, SEQ ID NO: 48, SEQ ID NO: 50, SEQ ID NO: 52, SEQ ID NO: 54, SEQ ID NO: 56, SEQ ID NO: 58, SEQ ID NO: 60 and SEQ ID NO: 62.

In one embodiment, the human heavy chain variable regions are all derived from a human $V_H 1$-2 gene segment that comprises a sequence selected from SEQ ID NO: 63, SEQ ID NO: 65, SEQ ID NO: 67, SEQ ID NO: 69 and SEQ ID NO: 71.

In one embodiment, the human heavy chain variable regions are derived from a human $V_H 1$-2 gene segment that comprises a sequence selected from SEQ ID NO: 64, SEQ ID NO: 66, SEQ ID NO: 68, SEQ ID NO: 70 and SEQ ID NO: 72.

In one aspect, use of a mouse as described herein to generate a variable region sequence for making a human antibody is provided, comprising (a) immunizing a mouse as described herein with an antigen of interest, (b) isolating a lymphocyte from the immunized mouse of (a), (c) exposing the lymphocyte to one or more labeled antibodies, (d) identifying a lymphocyte that is capable of binding to the antigen of interest, and (e) amplifying one or more variable region nucleic acid sequence from the lymphocyte thereby generating a variable region sequence.

In one embodiment, the lymphocyte is derived from the spleen of the mouse. In one embodiment, the lymphocyte is derived from a lymph node of the mouse. In one embodiment, the lymphocyte is derived from the bone marrow of the mouse.

In one embodiment, the labeled antibody is a fluorophore-conjugated antibody. In one embodiment, the one or more fluorophore-conjugated antibodies are selected from an IgM, an IgG, and/or a combination thereof.

In one embodiment, the lymphocyte is a B cell.

In one embodiment, the one or more variable region nucleic acid sequence comprises a heavy chain variable region sequence. In one embodiment, the one or more variable region nucleic acid sequence comprises a light chain variable region sequence. In a specific embodiment, the light chain variable region sequence is an immunoglobulin κ light chain variable region sequence. In one embodiment, the one or more variable region nucleic acid sequence comprises a heavy chain and a κ light chain variable region sequence.

In one embodiment, use of a mouse as described herein to generate a heavy and a κ light chain variable region sequence for making a human antibody is provided, comprising (a) immunizing a mouse as described herein with an antigen of interest, (b) isolating the spleen from the immunized mouse of (a), (c) exposing. B lymphocytes from the spleen to one or more labeled antibodies, (d) identifying a B lymphocyte of (c) that is capable of binding to the antigen of interest, and (e) amplifying a heavy chain variable region nucleic acid sequence and a κ light chain variable region nucleic acid sequence from the B lymphocyte thereby generating the heavy chain and κ light chain variable region sequences.

In one embodiment, use of a mouse as described herein to generate a heavy and a κ light chain variable region sequence for making a human antibody is provided, comprising (a) immunizing a mouse as described herein with an antigen of interest, (b) isolating one or more lymph nodes from the immunized mouse of (a), (c) exposing B lymphocytes from the one or more lymph nodes to one or more labeled antibodies, (d) identifying a B lymphocyte of (c) that is capable of binding to the antigen of interest, and (e) amplifying a heavy chain variable region nucleic acid sequence and a κ light chain variable region nucleic acid sequence from the B lymphocyte thereby generating the heavy chain and κ light chain variable region sequences.

In one embodiment, use of a mouse as described herein to generate a heavy and a κ light chain variable region sequence for making a human antibody is provided, comprising (a) immunizing a mouse as described herein with an antigen of interest, (b) isolating bone marrow from the immunized mouse of (a), (c) exposing B lymphocytes from the bone marrow to one or more labeled antibodies, (d) identifying a B lymphocyte of (c) that is capable of binding to the antigen of interest, and (e) amplifying a heavy chain variable region nucleic acid sequence and a κ light chain variable region nucleic acid sequence from the B lymphocyte thereby generating the heavy chain and κ light chain variable region sequences. In various embodiments, the one or more labeled antibodies are selected from an IgM, an IgG, and/or a combination thereof.

In various embodiments, the antigen of interest is a pathogen that afflicts human subjects including, e.g., a viral antigen. Exemplary viral pathogens include, e.g., mainly those of the families of Adenoviridae, bacteria Picornaviridae, Herpesviridae, Hepadnaviridae, Flaviviridae, Retroviridae, Orthomyxoviridae, Paramyxoviridae, Papovaviridae, Polyomavirus, Rhabdoviridae, and Togaviridae. Such exemplary viruses typically range between 20-300 nanometers in length. In various embodiments, the antigen of interest is a viral antigen selected from a hepatitis virus (e.g., HCV, HBV, etc.), a human immunodeficiency virus (HIV), or an influenza virus.

In various embodiments, use of a mouse as described herein to generate a heavy and κ light chain variable region sequence for making a human antibody is provided, further comprising fusing the amplified heavy and light chain variable region sequences to human heavy and light chain constant region sequences, expressing the fused heavy and light chain sequences in a cell, and recovering the expressed heavy and light chain sequences thereby generating a human antibody.

In various embodiments, the human heavy chain constant regions are selected from IgM, IgD, IgA, IgE and IgG. In various specific embodiments, the IgG is selected from an IgG1, an IgG2, an IgG3 and an IgG4. In various embodiments, the human heavy chain constant region comprises a $C_H1$, a hinge, a $C_H2$, a $C_H3$, a $C_H4$, or a combination thereof. In various embodiments, the light chain constant region is an immunoglobulin κ constant region. In various embodiments, the cell is selected from a HeLa cell, a DU145 cell, a Lncap cell, a MCF-7 cell, a MDA-MB-438 cell, a PC3 cell, a T47D cell, a THP-1 cell, a U87 cell, a SHSY5Y (human neuroblastoma) cell, a Saos-2 cell, a Vero cell, a CHO cell, a GH3 cell, a PC12 cell, a human retinal cell (e.g., a PER.C6™ cell), and a MC3T3 cell. In a specific embodiment, the cell is a CHO cell.

In one aspect, a method for generating a reverse-chimeric rodent-human antibody specific against an antigen of interest is provided, comprising the steps of immunizing a mouse as described herein with the antigen, isolating at least one cell from the mouse producing a reverse-chimeric mouse-human antibody specific against the antigen, culturing at least one cell producing the reverse-chimeric mouse-human antibody specific against the antigen, and obtaining said antibody.

In one embodiment, the reverse-chimeric mouse-human antibody comprises a human heavy chain variable domain fused with a mouse or rat heavy chain constant gene, and a human light chain variable domain fused with a mouse or rat or human light chain constant gene. In a specific embodiment, the human heavy chain variable domain contains a rearranged human $V_H1$-69 or human $V_H1$-2 gene segment.

In one embodiment, culturing at least one cell producing the reverse-chimeric rodent-human antibody specific against the antigen is performed on at least one hybridoma cell generated from the at least one cell isolated from the mouse.

In one aspect, a method for generating a fully human antibody specific against an antigen of interest is provided, comprising the steps of immunizing a mouse as described herein with the antigen, isolating at least one cell from the mouse producing a reverse-chimeric rodent-human antibody specific against the antigen, generating at least one cell producing a fully human antibody derived from the reverse-chimeric rodent-human antibody specific against the antigen, and culturing at least one cell producing the fully human antibody, and obtaining said fully human antibody.

In various embodiments, the at least one cell isolated from the mouse producing a reverse-chimeric rodent-human antibody specific against the antigen is a splenocyte or a B cell.

In various embodiments, the antibody is a monoclonal antibody.

In various embodiments, the antibody comprises a heavy chain variable domain that contains a rearranged human. $V_H1$-69 or human $V_H1$-2 gene segment.

In various embodiments, immunization with the antigen of interest is carried out with protein, DNA, a combination of DNA and protein, or cells expressing the antigen.

In one aspect, use of a mouse as described herein to make a nucleic acid sequence encoding an immunoglobulin variable region or fragment thereof is provided.

In one embodiment, the nucleic acid sequence is used to make a human antibody or antigen-binding fragment thereof. In one embodiment, the mouse is used to make an antigen-binding protein selected from an antibody, a multi-specific antibody (e.g., a bi-specific antibody), an scFv, a bi-specific scFv, a diabody, a triabody, a tetrabody, a V-NAR, a $V_{HH}$, a $V_L$, a F(ab), a F(ab)$_2$, a DVD (i.e., dual variable domain antigen-binding protein), a an SVD (i.e., single variable domain antigen-binding protein), or a bispecific T-cell engager (BiTE).

In one aspect, a method for making a human antigen-binding protein is provided, comprising exposing a genetically engineered non-human animal as described herein to an antigen of interest, allowing the non-human animal to mount an immune response to the antigen, obtaining from the non-human animal a heavy chain variable domain nucleic acid sequence encoding a human heavy chain variable domain that specifically binds the antigen of interest, fusing the heavy chain variable domain nucleic acid sequence to a human constant region sequence, and expressing in a mammalian cell an antibody comprising the human heavy chain variable domain sequence and the human constant region sequence. In one embodiment, the mammalian cell is a CHO cell. In one embodiment the non-human animal comprises a human $V_H$ gene segment repertoire that consists essentially of a single human $V_H$ gene segment, optionally present in two or more polymorphic variants thereof, operably linked to one or more human D and/or J segments. In one embodiment, the human $V_H$ gene segment repertoire is at an endogenous non-human $V_H$ gene segment locus. In one embodiment, the human $V_H$ gene segment repertoire is at a locus that is not an endogenous $V_H$ gene segment locus. In one embodiment, the human $V_H$ gene segment rearranges with a human D segment and a human J segment to form a rearranged human VDJ gene operably linked to a constant region sequence, wherein the constant region sequence is selected from a human sequence and a rodent sequence (e.g., a mouse or rat or hamster sequence). In one embodiment, the constant region sequence comprises a sequence selected from a $C_H1$, a hinge, a $C_H2$, a $C_H3$, and a combination thereof; in a specific embodiment, the constant region sequence comprises a $C_H1$, a hinge, a $C_H2$, and a $C_H3$. In one embodiment, the human variable domain and the constant sequence are expressed in the mammalian cell with a cognate human light chain variable domain obtained from the same mouse (e.g., sequence obtained from the same B cell as the human variable domain sequence); in one embodiment the sequence encoding the human light chain variable domain obtained from the mouse is then fused with a sequence encoding a human light chain constant sequence, and the light chain sequence and the heavy chain sequence are expressed in the mammalian cell.

In one aspect, a method for making an antibody heavy chain variable domain that binds an antigen of interest is provided, comprising expressing in a single cell (a) a first $V_H$ sequence of an immunized non-human animal as described herein, wherein the first $V_H$ sequence is fused with a $C_H$ gene sequence; and (b) a $V_L$ gene sequence of an immunized non-human animal as described herein, wherein the $V_L$ gene sequence is fused with a human $C_L$ gene sequence; maintaining the cell under conditions sufficient to express an antibody; and, isolating the antibody heavy chain variable domain. In one embodiment, the $V_L$ gene sequence is cognate with the first $V_H$ sequence.

In one embodiment, the cell comprises a second $V_H$ gene sequence of an immunized non-human animal as described herein, wherein the second $V_H$ gene sequence is fused with a $C_H$ gene sequence, wherein the first $V_H$ gene sequence encodes a $V_H$ domain that specifically binds a first epitope, and the second $V_H$ gene sequence encodes a $V_H$ domain that specifically binds a second epitope, wherein the first epitope and the second epitope are not identical.

In one embodiment, the constant region sequences are all human constant region sequences.

In one aspect, a method for making a human bispecific antibody is provided, comprising making the bispecific antibody using human variable region gene sequences of B cells of a non-human animal as described herein.

In one embodiment, the method comprises (a) identifying a clonally selected lymphocyte of the non-human animal, wherein the non-human animal has been exposed to an antigen of interest and allowed to develop an immune response to the antigen of interest, and wherein the lymphocyte expresses an antibody that specifically binds the antigen of interest, (b) obtaining from the lymphocyte or the antibody a nucleotide sequence that encodes a human heavy chain variable region that specifically binds the antigen of interest, and (c) employing the nucleotide sequence that encodes the human heavy chain variable region that specifically binds the antigen of interest in making the bispecific antibody. In a specific embodiment, the human heavy chain variable region comprises a rearranged $V_H1$-2 or $V_H1$-69 gene segment.

In one embodiment, steps (a) through (c) are performed a first time for a first antigen of interest to generate a first human heavy chain variable region sequence, and steps (a) through (c) are performed a second time for a second antigen of interest to generate a second human heavy chain variable region sequence, and wherein the first human heavy chain variable region sequence is expressed fused with a first human heavy chain constant region to form a first human heavy chain, the second human heavy chain variable region sequence is expressed fused with a second human heavy chain constant region to form a second human heavy chain, wherein the first and the second human heavy chains are expressed in the presence of a single human light chain expressed from a rearranged human Vκ1-39 or a human Vκ3-20 gene segment. In a specific embodiment, the single human light chain comprises a germline sequence.

In one embodiment, the method comprises (a) cloning heavy chain variable regions from B cells of a non-human animal as described herein which has been exposed to a first antigen of interest, and the same non-human animal, or a different non-human animal which is genetically the same and has been exposed to a second antigen of interest; and (b) expressing in a cell the heavy chain variable regions of (a) with the same heavy chain constant region and the same light chain to make a bispecific antibody.

In one aspect, a use of a non-human animal as described herein is provided, to obtain a nucleic acid sequence that encodes a human heavy chain variable domain. In one embodiment, the heavy chain variable domain comprises a rearranged human $V_H$ gene segment selected from $V_H1$-2 and $V_H1$-69.

In one aspect, a use of a non-human animal as described herein is provided, to obtain a cell that encodes a human heavy chain variable domain. In one embodiment, the heavy chain variable domain comprises a rearranged human $V_H$ gene segment selected from $V_H1$-2 and $V_H1$-69.

In one aspect, use of a non-human animal as described herein to make a human antibody variable domain is provided. In one aspect, use of a non-human animal as described herein to make a human antibody is provided. In one embodiment, the human antibody is a human bispecific antibody. In various embodiments, the variable domain and/or the antibody comprises a rearranged human $V_H$ gene segment selected from $V_H1-2$ and $V_H1-69$.

In one aspect, use of a non-human animal as described herein is provided to select a human immunoglobulin heavy chain variable domain. In one embodiment, the heavy chain variable domain comprises a rearranged human $V_H$ gene segment selected from $V_H1-2$ and $V_H1-69$.

In one aspect, use of a mouse as described herein to introduce an ectopic ADAM6 sequence into a mouse that lacks a functional endogenous mouse ADAM6 sequence is provided, wherein the use comprises mating a mouse as described herein with the mouse that lacks the functional endogenous mouse ADAM6 sequence.

In one aspect, use of genetic material from a mouse as described herein to make a mouse having an ectopic ADAM6 sequence is provided. In one embodiment, the use comprises nuclear transfer using a nucleus of a cell of a mouse as described herein. In one embodiment, the use comprises cloning a cell of a mouse as described herein to produce an animal derived from the cell. In one embodiment, the use comprises employing a sperm or an egg of a mouse as described herein in a process for making a mouse comprising the ectopic ADAM6 sequence.

In one aspect, a method for making a fertile male mouse comprising a modified immunoglobulin heavy chain locus is provided, comprising fertilizing a first mouse germ cell that comprises a modification of an endogenous immunoglobulin heavy chain locus with a second mouse germ cell that comprises an ADAM6 gene or ortholog or homolog or fragment thereof that is functional in a male mouse; forming a fertilized cell; allowing the fertilized cell to develop into an embryo; and, gestating the embryo in a surrogate to obtain a mouse.

In one embodiment, the fertilization is achieved by mating a male mouse and a female mouse. In one embodiment, the female mouse comprises the ADAM6 gene or ortholog or homolog or fragment thereof. In one embodiment, the male mouse comprises the ADAM6 gene or ortholog or homolog or fragment thereof.

In one aspect, use of a nucleic acid sequence encoding a mouse ADAM6 protein or an ortholog or homolog thereof or a functional fragment of the corresponding ADAM6 protein for restoring or enhancing the fertility of a mouse having a genome comprising a modification of an immunoglobulin heavy chain locus is provided, wherein the modification reduces or eliminates endogenous ADAM6 function.

In one embodiment, the nucleic acid sequence is integrated into the genome of the mouse at an ectopic position. In one embodiment, the nucleic acid sequence is integrated into the genome of the mouse at an endogenous immunoglobulin locus. In a specific embodiment, the endogenous immunoglobulin locus is a heavy chain locus. In one embodiment, the nucleic acid sequence is integrated into the genome of the mouse at a position other than an endogenous immunoglobulin locus.

In one aspect, use of the mouse as described herein for the manufacture of a medicament (e.g., an antigen-binding protein), or for the manufacture of a sequence encoding a variable sequence of a medicament (e.g., an antigen-binding protein), for the treatment of a human disease or disorder is provided. In one embodiment, the variable sequence of a medicament comprises a polymorphic human $V_H$ gene segment. In one embodiment, the variable sequence of a medicament comprises a human $V_H1-69$ gene segment. In one embodiment, the variable sequence of a medicament comprises a human $V_H1-2$ gene segment.

In one aspect, a nucleic acid construct encoding an immunoglobulin variable domain made in a mouse as described herein is provided. In one embodiment, the variable domain is a heavy chain variable domain. In a specific embodiment, the heavy chain variable domain comprises a human $V_H$ gene segment selected from $V_H1-2$, $V_H1-69$, $V_H2-26$, $V_H2-70$, or $V_H3-23$. In another specific embodiment, the heavy chain variable domain comprises a human $V_H1-2$ gene segment. In another specific embodiment, the heavy chain variable domain comprises a human $V_H1-69$ gene segment.

In one embodiment, the variable domain is a light chain variable domain. In a specific embodiment, the variable domain is a κ light chain variable domain that is cognate with a human heavy chain variable domain that comprises a rearranged human $V_H1-69$ gene segment. In a specific embodiment, the variable domain is a κ light chain variable domain that is cognate with a human heavy chain variable domain that comprises a rearranged human $V_H1-2$ gene segment.

In one aspect, use of a mouse as described herein to make a nucleic acid construct encoding a human immunoglobulin variable domain is provided. In one embodiment, the variable domain is a light chain variable domain. In one embodiment, the variable domain is a κ light chain variable domain that comprises a rearranged human Vκ gene segment selected from Vκ4-1, Vκ5-2, Vκ7-3, Vκ2-4, Vκ1-5, Vκ1-6, Vκ3-7, Vκ1-8, Vκ1-9, Vκ2-10, Vκ3-11, Vκ1-12, Vκ1-13, Vκ2-14, Vκ3-15, Vκ1-16, Vκ1-17, Vκ2-18, Vκ2-19, Vκ3-20, Vκ6-21, Vκ1-22, Vκ1-23, Vκ2-24, Vκ3-25, Vκ2-26, Vκ1-27, Vκ2-28, Vκ2-29, Vκ2-30, Vκ3-31, Vκ1-32, Vκ1-33, Vκ3-34, Vκ1-35, Vκ2-36, Vκ1-37, Vκ2-38, Vκ1-39, and Vκ2-40.

In one embodiment, the variable domain is a heavy chain variable domain. In a specific embodiment, the heavy chain variable domain comprises a rearranged human $V_H$ gene segment selected from $V_H1-2$, $V_H1-69$, $V_H2-26$, $V_H2-70$, or $V_H3-23$. In a specific embodiment, the heavy chain variable domain comprises a rearranged human $V_H1-69$ gene segment. In a specific embodiment, the heavy chain variable domain comprises a rearranged human. $V_H1-2$ gene segment.

In one aspect, use of a mouse as described herein to make a human immunoglobulin variable domain is provided. In one embodiment, the variable domain is a light chain variable domain. In one embodiment, the variable domain is a κ light chain variable domain that comprises a rearranged human Vκ gene segment selected from Vκ4-1, Vκ5-2, Vκ7-3, Vκ2-4, Vκ1-5, Vκ1-6, Vκ3-7, Vκ1-8, Vκ1-9, Vκ2-10, Vκ3-11, Vκ1-12, Vκ1-13, Vκ2-14, Vκ3-15, Vκ1-16, Vκ1-17, Vκ2-18, Vκ2-19, Vκ3-20, Vκ6-21, Vκ1-22, Vκ1-23, Vκ2-24, Vκ3-25, Vκ2-26, Vκ1-27, Vκ2-28, Vκ2-29, Vκ2-30, Vκ3-31, Vκ1-32, Vκ1-33, Vκ3-34, Vκ1-35, Vκ2-36, Vκ1-37, Vκ2-38, Vκ1-39, and Vκ2-40.

In one embodiment, the variable domain is a heavy chain variable domain. In a specific embodiment, the heavy chain variable domain comprises a rearranged human $V_H$ gene segment selected from $V_H1-2$, $V_H1-69$, $V_H2-26$, $V_H2-70$, or $V_H3-23$. In a specific embodiment, the heavy chain variable domain comprises a rearranged human $V_H1-69$ gene segment. In a specific embodiment, the heavy chain variable domain comprises a rearranged human $V_H1-2$ gene segment.

The various aspects and embodiments are capable of use together, unless expressly noted otherwise or the context clearly prohibits use together.

BRIEF DESCRIPTION OF FIGURES

FIG. 5 shows the nucleotide alignment of the second exon for each of thirteen reported alleles for the human $V_H$1-69 gene. Lower case bases indicate germline nucleotide differences among the alleles. Complementary determining regions (CDRs) are indicated with boxes around the sequence. Dashes indicate artificial gaps for proper sequence alignment. $V_H$1-69*01 (SEQ ID NO: 37); $V_H$1-69*02 (SEQ ID NO: 39); $V_H$1-69*03 (SEQ ID NO: 41); $V_H$1-69*04 (SEQ ID NO: 43); $V_H$1-69*05 (SEQ ID NO: 45); $V_H$1-69*06 (SEQ ID NO: 47); $V_H$1-69*07 (SEQ ID NO: 49); $V_H$1-69*08 (SEQ ID NO: 51); $V_H$1-69*09 (SEQ ID NO: 53); $V_H$1-69*10 (SEQ ID NO: 55); $V_H$1-69*11 (SEQ ID NO: 57); $V_H$1-69*12 (SEQ ID NO: 59); $V_H$1-69*13 (SEQ ID NO: 61).

FIG. 6 shows the protein alignment of the mature heavy chain variable gene sequence for each of thirteen reported alleles for the human $V_H$1-69 gene. Lower case amino acids indicate germline differences among the alleles. Complementary determining regions (CDRs) are indicated with boxes around the sequence. Dashes indicate artificial gaps for proper sequence alignment. $V_H$1-69*01 (SEQ ID NO: 38); $V_H$1-69*02 (SEQ ID NO: 40); $V_H$1-69*03 (SEQ ID NO: 42); $V_H$1-69*04 (SEQ ID NO: 44); $V_H$1-69*05 (SEQ ID NO: 46); $V_H$1-69*06 (SEQ ID NO: 48); $V_H$1-69*07 (SEQ ID NO: 50); $V_H$1-69*08 (SEQ ID NO: 52); $V_H$1-69*09 (SEQ ID NO: 54); $V_H$1-69*10 (SEQ ID NO: 56); $V_H$1-69*11 (SEQ ID NO: 58); $V_H$1-69*12 (SEQ ID NO: 60); $V_H$1-69*13 (SEQ ID NO: 62).

FIG. 7 shows a percent identity/percent similarity matrix for the aligned protein sequences of the mature variable gene for each of thirteen reported alleles for the human $V_H$1-69 gene. Percent identity among the $V_H$1-69 alleles is indicated above the shaded boxes and percent similarity is indicated below the shaded boxes. Scores for percent identity and percent similarity were scored by a ClustalW (v1.83) alignment tool using MacVector software (MacVector, Inc., North Carolina).

FIG. 8 shows the nucleotide alignment of the second exon for each of five reported alleles for the human $V_H$1-2 gene. Lower case bases indicate germline nucleotide differences among the alleles. Complementary determining regions (CDRs) are indicated with boxes around the sequence. Dashes indicate artificial gaps for proper sequence alignment. $V_H$1-2*01 (SEQ ID NO: 63); $V_H$1-2*02 (SEQ ID NO: 65); $V_H$1-2*03 (SEQ ID NO: 67); $V_H$1-2*04 (SEQ ID NO: 69); $V_H$1-2*05 (SEQ ID NO: 71).

FIG. 9 shows the protein alignment of the mature heavy chain variable gene sequence for each of the five reported alleles for the human $V_H$1-2 gene. Lower case amino acids indicate germline differences among the alleles. Complementary determining regions (CDRs) are indicated with boxes around the sequence. Dashes indicate artificial gaps for proper sequence alignment. $V_H$1-2*01 (SEQ ID NO: 64); $V_H$1-2*02 (SEQ ID NO: 66); $V_H$1-2*03 (SEQ ID NO: 68); $V_H$1-2*04 (SEQ ID NO: 70); $V_H$1-2*05 (SEQ ID NO: 72).

FIG. 10 shows a percent identity/percent similarity matrix for the aligned protein sequences of the mature variable gene for each of five reported alleles for the human $V_H$1-2 gene. Percent identity among the $V_H$1-2 alleles is indicated above the shaded boxes and percent similarity is indicated below the shaded boxes. Scores for percent identity and percent similarity were scored by a ClustalW (v1.83) alignment tool using MacVector software (MacVector, Inc., North Carolina).

DETAILED DESCRIPTION

Figure 1:
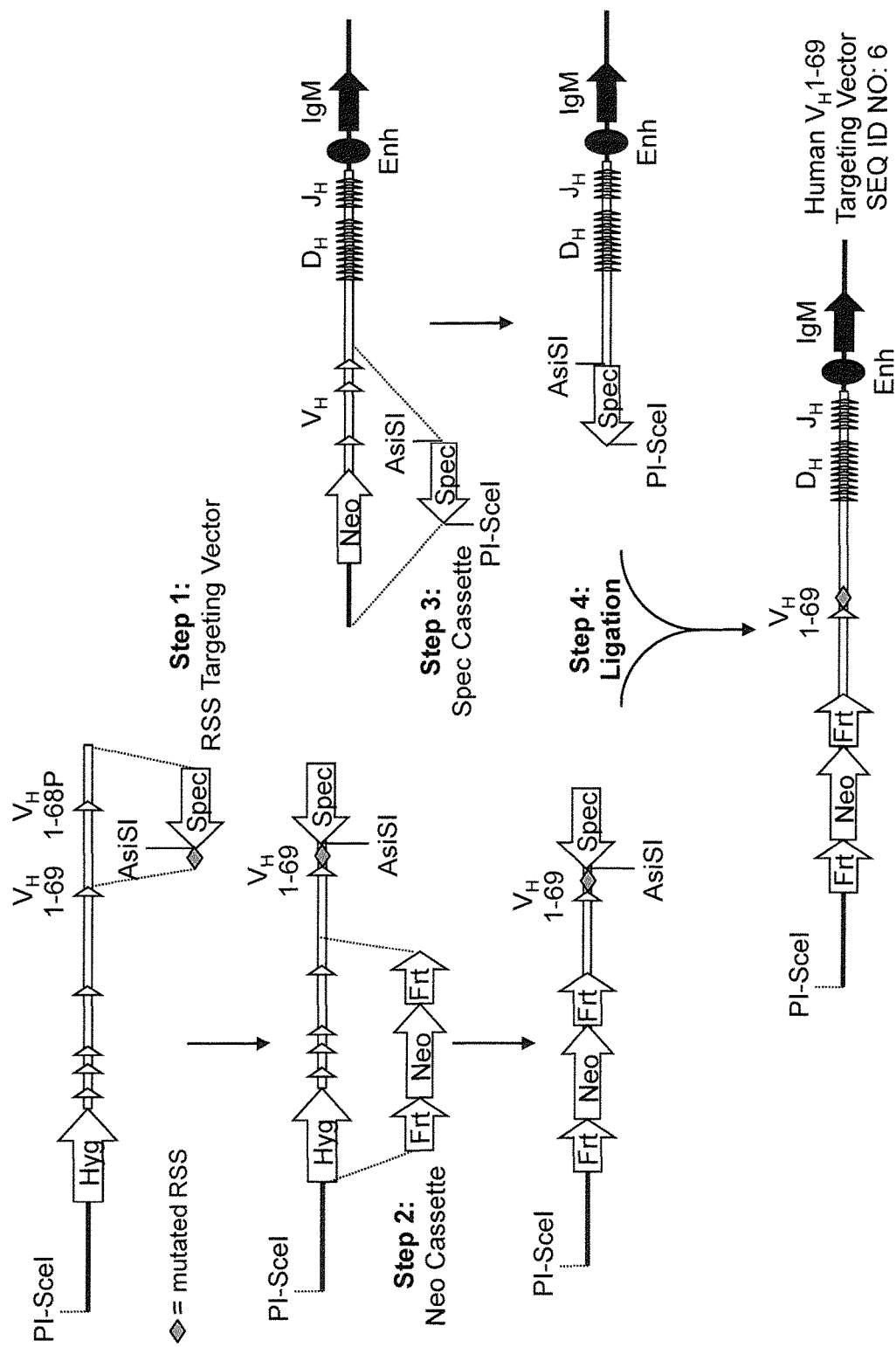
FIG. 1 shows a general illustration, not to scale, of a series of targeting and molecular engineering steps employed to make a targeting vector for construction of a modified heavy chain locus containing a single human $V_H$1-69 gene segment, twenty-seven human $D_H$ and six human $J_H$ gene segments at an endogenous immunoglobulin heavy chain locus.

This invention is not limited to particular methods, and experimental conditions described, as such methods and conditions may vary. It is also to be understood that the terminology used herein is for the purpose of describing particular embodiments only, and is not intended to be limiting, since the scope of the present invention is defined by the claims.

Unless defined otherwise, all terms and phrases used herein include the meanings that the terms and phrases have attained in the art, unless the contrary is clearly indicated or clearly apparent from the context in which the term or phrase is used. Although any methods and materials similar or equivalent to those described herein can be used in the practice or testing of the present invention, particular methods and materials are now described. All publications mentioned are hereby incorporated by reference.

The phrase "substantial" or "substantially" when used to refer to an amount of gene segments (e.g., "substantially all" V gene segments) includes both functional and non functional gene segments and include, in various embodiments, e.g., 80% or more, 85% or more, 90% or more, 95% or more 96% or more, 97% or more, 98% or more, or 99% or more of all gene segments; in various embodiments, "substantially all" gene segments includes, e.g., at least 95%, 96%, 97%, 98%, or 99% of functional (i.e., non-pseudogene) gene segments.

The term "replacement" includes wherein a DNA sequence is placed into a genome of a cell in such a way as to replace a sequence within the genome with a heterologous sequence (e.g., a human sequence in a mouse), at the locus of the genomic sequence. The DNA sequence so placed may include one or more regulatory sequences that are part of source DNA used to obtain the sequence so placed (e.g., promoters, enhancers, 5'- or 3'-untranslated regions, appropriate recombination signal sequences, etc.). For example, in various embodiments, the replacement is a substitution of an endogenous sequence for a heterologous sequence that results in the production of a gene product from the DNA sequence so placed (comprising the heterologous sequence), but not expression of the endogenous sequence; the replacement is of an endogenous genomic sequence with a DNA sequence that encodes a protein that has a similar function as a protein encoded by the endogenous genomic sequence (e.g., the endogenous genomic sequence encodes an immunoglobulin gene or domain, and the DNA fragment encodes one or more human immunoglobulin genes or domains). In various embodiments, an endogenous gene or fragment thereof is replaced with a corresponding human gene or fragment thereof. A corresponding human gene or fragment thereof is a human gene or fragment that is an ortholog of, a homolog of, or is substantially identical or the same in structure and/or function, as the endogenous gene or fragment thereof that is replaced.

The mouse as a genetic model has been greatly enhanced by transgenic and knockout technologies, which have allowed for the study of the effects of the directed overexpression or deletion of specific genes. Despite all of its advantages, the mouse still presents genetic obstacles that render it an imperfect model for human diseases and an imperfect platform to test human therapeutics or make them. First, although about 99% of human genes have a mouse homolog (Waterston et al. 2002, Initial sequencing and comparative analysis of the mouse genome, *Nature* 420: 520-562), potential therapeutics often fail to cross-react, or cross-react inadequately, with mouse orthologs of the intended human targets. To obviate this problem, selected target genes can be "humanized," that is, the mouse gene can be eliminated and replaced by the corresponding human orthologous gene sequence (e.g., U.S. Pat. No. 6,586,251, 6,596,541 and 7,105,348, incorporated herein by reference). Initially, efforts to humanize mouse genes by a "knockout-plus-transgenic humanization" strategy entailed crossing a mouse carrying a deletion (i.e., knockout) of the endogenous gene with a mouse carrying a randomly integrated human transgene (see, e.g., Bril et al., 2006, Tolerance to factor VIII in a transgenic mouse expressing human factor VIII cDNA carrying an Arg(593) to Cys substitution, *Thromb Haemost* 95:341-347; Homanics et al., 2006, Production and characterization of murine models of classic and intermediate maple syrup urine disease, *BMC Med Genet* 7:33; Jamsai et al., 2006, A humanized BAC transgenic/knockout mouse model for HbE/beta-thalassemia, *Genomics* 88(3):309-15; Pan et al., 2006, Different role for mouse and human CD3delta/epsilon heterodimer in preT cell receptor (preTCR) function:human CD3delta/epsilon heterodimer restores the defective preTCR function in CD3gamma- and CD3gammadelta-deficient mice, *Mol Immunol* 43:1741-1750). But those efforts were hampered by size limitations; conventional knockout technologies were not sufficient to directly replace large mouse genes with their large human genomic counterparts. A straightforward approach of direct homologous replacement, in which an endogenous mouse gene is directly replaced by the human counterpart gene at the same precise genetic location of the mouse gene (i.e., at the endogenous mouse locus), is rarely attempted because of technical difficulties. Until now, efforts at direct replacement involved elaborate and burdensome procedures, thus limiting the length of genetic material that could be handled and the precision with which it could be manipulated.

Exogenously introduced human immunoglobulin transgenes rearrange in precursor B cells in mice (Alt et al., 1985, immunoglobulin genes in transgenic mice, *Trends Genet* 1:231-236). This finding was exploited by engineering mice using the knockout-plus-transgenic approach to express human antibodies (Green et al., 1994, Antigen-specific human monoclonal antibodies from mice engineered with human Ig heavy and light chain YACs, *Nat Genet* 7:13-21; Lonberg et al., 1994, Antigen-specific human antibodies from mice comprising four distinct genetic modifications, *Nature* 368:856-859; Jakobovits et al., 2007, From Xeno-Mouse technology to panitumumab, the first fully human antibody product from transgenic mice, *Nat Biotechnol* 25:1134-1143). The mouse immunoglobulin heavy chain and κ light chain loci were inactivated in these mice by targeted deletion of small but critical portions of each endogenous locus, followed by introducing human immunoglobulin gene loci as randomly integrated large transgenes, as described above, or minichromosomes (Tomizuka et al., 2000, Double trans-chromosomic mice: maintenance of two individual human chromosome fragments containing Ig heavy and kappa loci and expression of fully human antibodies, *PNAS USA* 97:722-727). Such mice represented an important advance in genetic engineering; fully human monoclonal antibodies isolated from them yielded promising therapeutic potential for treating a variety of human diseases (Gibson et al., 2006, Randomized phase III trial results of panitumumab, a fully human anti-epidermal growth factor receptor monoclonal antibody, in metastatic colorectal cancer, *Clin Colorectal Cancer* 6:29-31; Jakobovits et al., 2007; Kim et al., 2007, Clinical efficacy of zanolimumab (HuMax-CD4): two Phase II studies in refractory cutaneous T-cell lymphoma, *Blood* 109(11):4655-62; Lonberg, 2005, Human antibodies from transgenic animals, *Nat Biotechnol* 23:1117-1125; Maker et al., 2005, Tumor regression and autoimmunity in patients treated with cytotoxic T lymphocyte-associated antigen 4 blockade and interleukin 2: a phase I/II study, *Ann Surg Oncol* 12:1005-1016; McClung et al., 2006, Denosumab in postmenopausal women with low bone mineral density, *New Engl J Med* 354:821-831). But, as discussed above, these mice exhibit compromised B cell development and immune deficiencies when compared to wild type mice. Such problems potentially limit the ability of the mice to support a vigorous humoral response and, consequently, generate fully human antibodies against some antigens. The deficiencies may be due to inefficient functionality due to the random introduction of the human immunoglobulin transgenes and resulting incorrect expression due to a lack of upstream and downstream control elements (Garrett et al., 2005, Chromatin architecture near a potential 3' end of the IgH locus involves modular regulation of histone modifications during B-Cell development and in vivo occupancy at CTCF sites, *Mol Cell Biol* 25:1511-1525; Manis et al., 2003, Elucidation of a downstream boundary of the 3' IgH regulatory region, *Mol Immunol* 39:753-760; Pawlitzky et al., 2006, Identification of a candidate regulatory element within the 5' flanking region of the mouse IgH locus defined by pro-B cell-specific hypersensitivity associated with binding of PU.1, Pax5, and E2A, *J Immunol* 176:6839-6851), inefficient interspecies interactions between human constant domains and mouse components of the B-cell receptor signaling complex on the cell surface, which may impair signaling processes required for normal maturation, proliferation, and survival of B cells (Hombach et al., 1990, Molecular components of the B-cell antigen receptor complex of the IgM class, *Nature* 343:760-762), and inefficient interspecies interactions between soluble human immunoglobulins and mouse Fc receptors that might reduce affinity selection (Rao et al., 2002, Differential expression of the inhibitory IgG Fc receptor FcgammaRIIB on germinal center cells: implications for selection of high-affinity B cells, *J Immunol* 169:1859-1868) and immunoglobulin serum concentrations (Brambell et al., 1964, A Theoretical Model of Gamma-Globulin Catabolism, *Nature* 203:1352-1354; Junghans and Anderson, 1996, The protection receptor for IgG catabolism is the beta2-microglobulin-containing neonatal intestinal transport receptor, *PNAS USA* 93:5512-5516; Rao et al., 2002; Hjelm et al., 2006, Antibody-mediated regulation of the immune response, *Scand J Immunol* 64:177-184; Nimmerjahn and Ravetch, 2007, Fc-receptors as regulators of immunity, *Adv Immunol* 96:179-204). These deficiencies can be corrected by in situ humanization of only the variable regions of the mouse immunoglobulin loci within their natural locations at the endogenous heavy and light chain loci. This would effectively result in mice that make "reverse chimeric" (i.e., human V:mouse C) antibodies which would be capable of normal interactions and selection with the mouse environment based on retaining mouse constant regions. Taking this approach, a particular version of a humanized locus can be constructed based on the complexity of the chimeric locus that is desired. Further such reverse chimeric antibodies may be readily reformatted into fully human antibodies for therapeutic purposes.

Genetically modified animals that comprise an insertion or a replacement at the endogenous immunoglobulin heavy chain locus with heterologous (e.g., from another species) immunoglobulin sequences can be made in conjunction with insertions or replacements at endogenous immunoglobulin light chain loci or in conjunction with immunoglobulin light chain transgenes (e.g., chimeric immunoglobulin light chain transgenes or fully human fully mouse, etc.). The species from which the heterologous immunoglobulin heavy chain sequences are derived can vary widely; as with immunoglobulin light chain sequences employed in immunoglobulin light chain sequence replacements or immunoglobulin light chain transgenes. Exemplary heterologous immunoglobulin heavy chain sequences include human sequences.

Immunoglobulin variable region nucleic acid sequences, e.g., V, D, and/or J segments, are in various embodiments obtained from a human or a non-human animal. Non-human animals suitable for providing V, D, and/or J segments include, for example bony fish, cartilaginous fish such as sharks and rays, amphibians, reptiles, mammals, birds (e.g., chickens). Non-human animals include, for example, mammals. Mammals include, for example, non-human primates, goats, sheep, pigs, dogs, bovine (e.g., cow, bull, buffalo), deer, camels, ferrets and rodents and non-human primates (e.g., chimpanzees, orangutans, gorillas, marmosets, rhesus monkeys baboons). Suitable non-human animals are selected from the rodent family including rats, mice, and hamsters. In one embodiment, the non-human animals are mice. As clear from the context, various non-human animals can be used as sources of variable domains or variable region gene segments (e.g., sharks, rays, mammals, e.g., camels, rodents such as mice and rats).

According to the context, non-human animals are also used as sources of constant region sequences to be used in connection with variable sequences or segments, for example, rodent constant sequences can be used in transgenes operably linked to human or non-human variable sequences (e.g., human or non-human primate variable sequences operably linked to, e.g., rodent, e.g., mouse or rat or hamster, constant sequences). Thus, in various embodiments, human V, D, and/or J segments are operably linked to rodent (e.g., mouse or rat or hamster) constant region gene sequences. In some embodiments, the human V, D, and/or J segments (or one or more rearranged VDJ or VJ genes) are operably linked or fused to a mouse, rat, or hamster constant region gene sequence in, e.g., a transgene integrated at a locus that is not an endogenous immunoglobulin locus.

In a specific embodiment, a mouse is provided that comprises a replacement of $V_H$, $D_H$, and $J_H$ gene segments at an endogenous immunoglobulin heavy chain locus with a single human $V_H$, one or more $D_H$, and one or more $J_H$ gene segments, wherein the single human $V_H$, one or more $D_H$, and one or more $J_H$ gene segments are operably linked to an endogenous immunoglobulin heavy chain gene: wherein the mouse comprises a transgene at a locus other than an endogenous immunoglobulin locus, wherein the transgene comprises an unrearranged or rearranged human $V_L$ and human $J_L$ gene segment operably linked to a mouse or rat or human constant region. In various embodiments, the single human $V_H$ gene segment is a polymorphic gene segment. In one embodiment, the single human $V_H$ gene segment is a human $V_H$1-69 gene segment or a human $V_H$1-2 gene segment.

A method for an in situ genetic replacement of the mouse germline immunoglobulin heavy chain variable gene locus with a restricted human germline immunoglobulin heavy chain locus and replacement of the mouse germline immunoglobulin κ light chain variable gene loci with human germline immunoglobulin κ light chain loci, while maintaining the ability of the mice to generate offspring, is described. Specifically, the precise replacement of six megabases of both the mouse heavy chain and κ light chain immunoglobulin variable gene loci with human immunoglobulin heavy and κ light chain sequences, while leaving the mouse constant regions intact, is described. As a result, mice have been created that have a precise replacement of their entire germline immunoglobulin variable repertoire with human germline immunoglobulin variable sequences, while maintaining mouse constant regions. The human variable regions are linked to mouse constant regions to form chimeric human-mouse immunoglobulin loci that rearrange and express at physiologically appropriate levels. The antibodies expressed are "reverse chimeras," i.e., they comprise human variable region sequences and mouse constant region sequences.

The genetically modified mice described herein exhibit a fully functional humoral immune system and provide a plentiful source of naturally affinity-matured human immunoglobulin variable region sequences for making pharmaceutically acceptable antibodies and other antigen-binding proteins that are effective for combating pathogenic antigens, e.g., viral antigens.

The engineering of human immunoglobulin sequences in the genome of a mouse, even at precise locations, e.g., at the endogenous mouse immunoglobulin loci, may present certain challenges due to divergent evolution of the immunoglobulin loci between mouse and man. For example, intergenic sequences interspersed within the immunoglobulin loci are not identical between mice and humans and, in some circumstances, may not be functionally equivalent. Differences between mice and humans in their immunoglobulin loci can still result in abnormalities in humanized mice, particularly when humanizing or manipulating certain portions of endogenous mouse immunoglobulin heavy chain loci. Some modifications at mouse immunoglobulin heavy chain loci are deleterious. Deleterious modifications can include, for example, loss of the ability of the modified mice to mate and produce offspring. In various embodiments, engineering human immunoglobulin sequences in the genome of a mouse includes methods that maintain endogenous sequences that when absent in modified mouse strains are deleterious. Exemplary deleterious effects may include inability to propagate modified strains, loss of function of essential genes, inability to express polypeptides, etc. Such deleterious effects may be directly or indirectly related to the modification engineered into the genome of the mouse.

Notwithstanding the near wild-type humoral immune function observed in mice with humanized immunoglobulin loci, there are other challenges encountered when employing a direct replacement of immunoglobulin sequences that is not encountered in some approaches that employ randomly integrated transgenes. Differences in the genetic composition of the immunoglobulin loci between mice and humans has lead to the discovery of sequences beneficial for the propagation of mice with replaced immunoglobulin gene segments. Specifically, mouse ADAM genes located within the endogenous immunoglobulin locus are optimally present in mice with replaced immunoglobulin loci, due to their role in fertility.

Figure 8:
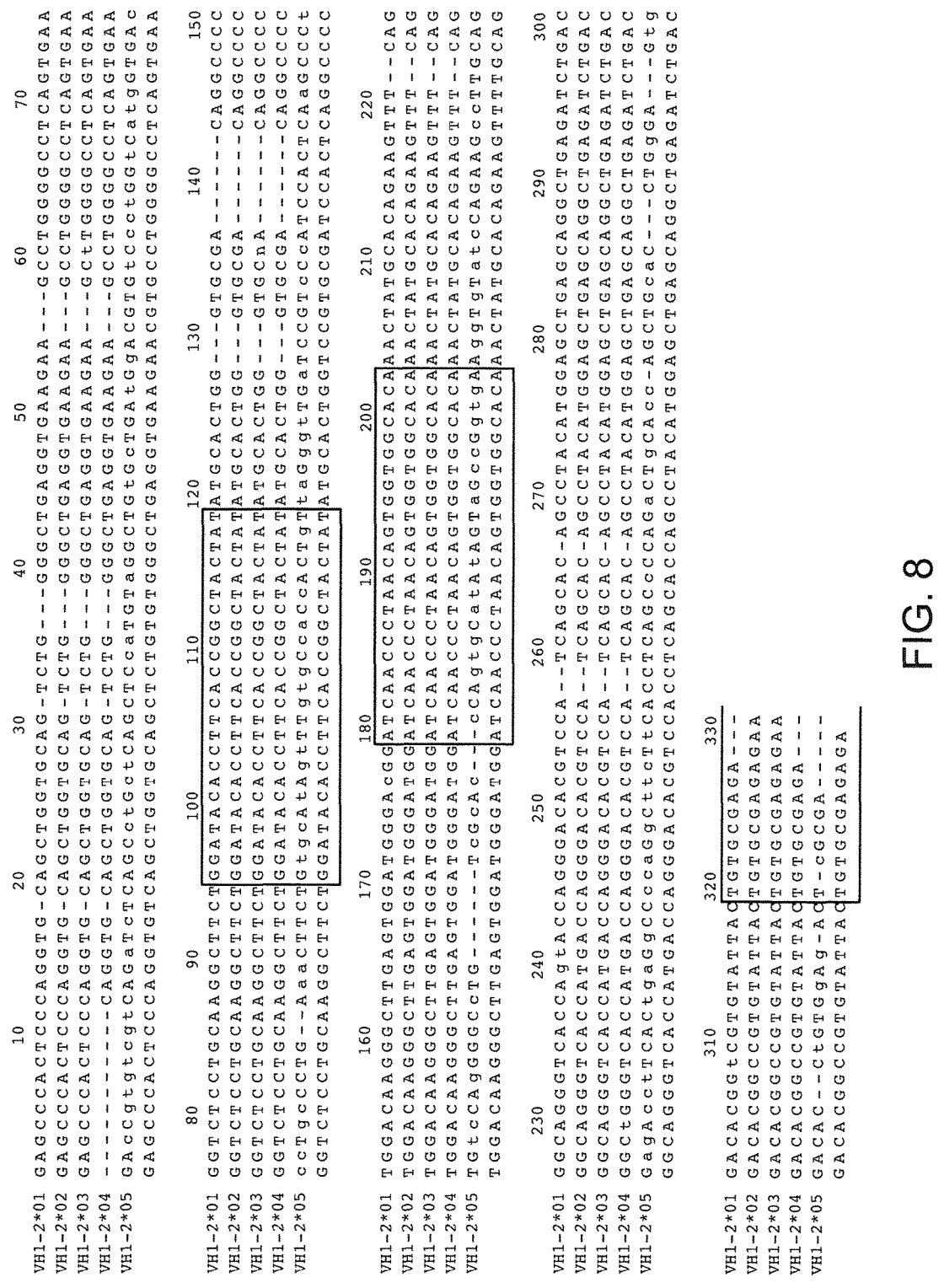

A precise, in situ replacement of six megabases of the variable regions of the mouse heavy chain immunoglobulin loci ($V_H$-$D_H$-$J_H$) with a restricted human immunoglobulin heavy chain locus was performed, while leaving the flanking mouse sequences intact and functional within the hybrid loci, including all mouse constant chain genes and locus transcriptional control regions (FIG. 1 and FIG. 8). Further engineering steps were performed to maintain mouse sequences that confer on the mouse the ability to mate and produce offspring in a manner comparable to a wild-type mouse (FIG. 9 and FIG. 10). Specifically, a single human $V_H$, 27 $D_H$, and six $J_H$ gene segments and mouse ADAM6 genes were introduced through chimeric BAC targeting vectors into mouse ES cells using VELOCIGENE® genetic engineering technology (see, e.g., U.S. Pat. No. 6,586,251 and Valenzuela et al., 2003, High-throughput engineering of the mouse genome coupled with high-resolution expression analysis, *Nat Biotechnol* 21:652-659).

Mice with Restricted Immunoglobulin Heavy Chain Variable Gene Segments

Non-human animals comprising immunoglobulin loci that comprise a restricted number of $V_H$ genes, and one or more D genes and one or more J genes, are provided, as are methods of making and using them. When immunized with an antigen of interest, the non-human animals generate B cell populations with antibody variable regions derived only from the restricted, pre-selected $V_H$ gene or set of $V_H$ genes (e.g., a pre-selected $V_H$ gene and variants thereof). In various embodiments, non-human animals are provided that generate B cell populations that express human antibody variable domains that are human heavy chain variable domains, along with cognate human light chain variable domains. In various embodiments, the non-human animals rearrange human heavy chain variable gene segments and human light chain variable gene segments from modified endogenous mouse immunoglobulin loci that comprise a replacement or insertion of the non-human unrearranged variable region sequences with human unrearranged variable region sequences.

Early work on the organization, structure, and function of the immunoglobulin genes was done in part on mice with disabled endogenous loci and engineered to have transgenic loci (randomly placed) with partial human immunoglobulin genes, e.g., a partial repertoire of human heavy chain genes linked with a human constant gene, randomly inserted into the genome, in the presence or absence of a human light chain transgene. Although these mice were somewhat less than optimal for making useful high affinity antibodies, they facilitated certain functional analyses of immunoglobulin loci. Some of these mice had as few as two or three, or even just a single, heavy chain variable gene.

Mice that express fully human immunoglobulin heavy chains derived from a single human $V_H$5-51 gene and 10 human $D_H$ genes and six human $J_H$ genes, with human μ and γ1 constant genes, on a randomly inserted transgene (and disabled endogenous immunoglobulin loci) have been reported (Xu and Davis, 2000, Diversity in the CDR3 Region of $V_H$ Is Sufficient for Most Antibody Specificities, *Immunity* 13:37-45). The fully human immunoglobulin heavy chains of these mice are mostly expressed with one of just two fully mouse λ light chains derived from the endogenous mouse λ light chain locus (Vλ1-Jλ1 or Vλ2-Jλ2 only), and can express no κ light chain (the mice are Igκ$^{-/-}$). These mice exhibit severely abnormal dysfunction in B cell development and antibody expression. B cell numbers are reportedly 5-10% of wild-type, IgM levels 5-10% of wild-type, and IgG1 levels are only 0.1-1% of wild-type. The observed IgM repertoire revealed highly restricted junctional diversity. The fully human heavy chains display largely identical CDR3 length across antigens, the same $J_H$ ($J_H$2) usage across antigens, and an initial junctional Q residue, thus reflecting a certain lack of CDR3 diversity. The fully mouse λ light chains nearly all had a W96L substitution in Jλ1 as initial junctional residue. The mice are reportedly unable to generate any antibodies against bacterial polysaccharide. Because the human variable domains couple with mouse light chains, the utility of the human variable regions is highly limited.

Other mice that have just a single human $V_H$3-23 gene, human $D_H$ and $J_H$ genes, and mouse light chain genes have been reported, but they exhibit a limited diversity (and thus a limited usefulness) due in part to mispairing potential between human $V_H$ and mouse $V_L$ domains (see, e.g., Mageed et al., 2001, Rearrangement of the human heavy chain variable region gene V3-23 in transgenic mice generates antibodies reactive with a range of antigens on the basis of $V_H$CDR3 and residues intrinsic to the heavy chain variable region, *Clin. Exp. Immunol.* 123:1-5). Similarly, mice that bear two $V_H$ genes (3-23 and 6-1) along with human $D_H$ and $J_H$ genes in a transgene containing the human μ constant gene (Bruggemann et al., 1991, Human antibody production in transgenic mice: expression from 100 kb of the human IgH locus, *Eur. J. Immmunol.* 21:1323-1326) and express them in human IgM chains with mouse light chains may exhibit a repertoire limited by mispairing (Mackworth-Young at al., 2003, The role of antigen in the selection of the human. V3-23 immunoglobulin heavy chain variable region gene, *Clin. Exp. Immunol.* 134:420-425).

Other transgenic mice that express $V_H$-restricted fully human heavy chains from a human transgene randomly inserted in the genome, with a limited human λ repertoire expressed from a fully human randomly inserted transgene, have also been reported (see, e.g., Taylor et al., 1992, A transgenic mouse that expresses a diversity of human sequence heavy and light chain immunoglobulins, *Nucleic Acids Res.* 20(23):6287-6295; Wagner et al., 1994, Antibodies generated form human immunoglobulin miniloci in transgenic mice, *Nucleic Acids Res.* 22(8):1389-1393). However, transgenic mice that express fully human antibodies from transgenes randomly integrated into the mouse genome, and that comprise damaged endogenous loci, are known to exhibit substantial differences in immune response as compared with wild-type mice that affect the diversity of the antibody variable domains obtainable from such mice.

Useful non-human animals that generate a diverse population of B cells that express human antibody variable domains from a restricted $V_H$ gene repertoire and one or more D genes and one or more J genes will be capable of generating, preferably in some embodiments, repertoires of rearranged variable region genes that will be sufficiently diverse. In various embodiments, diversity includes junctional diversity, somatic hypermutation, and polymorphic diversity in $V_H$ gene sequence (for embodiments where $V_H$ genes are present in polymorphic forms). Combinatorial diversity occurs in the pairing of the $V_H$ gene with one of a plurality of cognate human light chain variable domains (which, in various embodiments, comprise junctional diversity and/or somatic hypermutations).

Non-human animals comprising a restricted human $V_H$ gene repertoire and a complete or substantially complete human $V_L$ gene repertoire will in various embodiments generate populations of B cells that reflect the various sources of diversity, such as junctional diversity (e.g., VDJ, VJ joining, P additions, N additions), combinatorial diversity (e.g., cognate $V_H$-restricted human heavy, human light), and somatic hypermutations. In embodiments comprising a restriction of the $V_H$ repertoire to one human $V_H$ gene, the one human $V_H$ gene can be present in two or more variants. In various embodiments, the presence of two or more polymorphic forms of a $V_H$ gene will enrich the diversity of the variable domains of the B cell population.

Variations in the germline sequences of gene segments (e.g., V genes) contribute to the diversity of the antibody response in humans. The relative contribution to diversity due to V gene sequence differences varies among V genes. The degree of polymorphism varies across gene families, and is reflected in a plurality of haplotypes (stretches of sequence with coinherited polymorphisms) capable of generating further diversity as observed in $V_H$ haplotype differences between related and unrelated individuals in the human population (see, e.g., Souroujon et al., 1989, Polymorphisms in Human H Chain V Region Genes from the $V_H$III Gene Family, J. Immunol. 143(2):706-711). Some have suggested, based on data from particularly polymorphic human $V_H$ gene families, that haplotype diversity in the germline is a major contributor to $V_H$ gene heterogeneity in the human population, which is reflected in the large diversity of different germline $V_H$ genes across the human population. (see, Sasso et al., 1990, Prevalence and Polymorphism of Human $V_H$3 Genes, J. Immunol. 145(8):2751-2757).

Although the human population displays a large diversity of haplotypes with respect to the $V_H$ gene repertoire due to widespread polymorphism, certain polymorphisms are reflected in prevalent (i.e., conserved) alleles observed in the human population (Sasso at al., 1990). $V_H$ polymorphism can be described in two principle forms. The first is variation arising from allelic variation associated with differences among the nucleotide sequence between alleles of the same gene segment. The second arises from the numerous duplications, insertions, and/or deletions that have occurred at the immunoglobulin heavy chain locus. This has resulted in the unique situation in which $V_H$ genes derived by duplication from identical genes differ from their respective alleles by one or more nucleotide substitutions. This also directly influences the copy number of $V_H$ genes at the heavy chain locus.

Polymorphic alleles of the human immunoglobulin heavy chain variable gene segments ($V_H$ genes) have largely been the result of insertion/deletion of gene segments and single nucleotide differences within coding regions, both of which have the potential to have functional consequences on the immunoglobulin molecule. Table 1 sets forth the functional $V_H$ genes listed by human $V_H$ gene family and the number of identified alleles for each $V_H$ gene in the human immunoglobulin heavy chain locus. There are some findings to suggest that polymorphic $V_H$ genes have been implicated in susceptibility to certain diseases such as, for example, rheumatoid arthritis, whereas in other cases a linkage between $V_H$ and disease has been less clear. This ambiguity has been attributed to the copy number and presence of various alleles in different human populations. In fact, several human $V_H$ genes demonstrate copy number variation (e.g., $V_H$1-2, $V_H$1-69, $V_H$2-26, $V_H$2-70, and $V_H$3-23). In various embodiments, humanized mice as described herein with restricted $V_H$ repertoires comprise multiple polymorphic variants of an individual $V_H$ family member (e.g., two or more polymorphic variants of $V_H$1-2, $V_H$1-69, $V_H$2-26, $V_H$2-70, or $V_H$3-23, replacing all or substantially all functional mouse $V_H$ segments at an endogenous mouse locus). In a specific embodiment, the two or more polymorphic variants of mice described herein are in number up to and including the number indicated for the corresponding $V_H$ family member in Table 1 (e.g., for $V_H$1-69, 13 variants; for $V_H$1-2, five variants; etc.).

Commonly observed variants of particular human $V_H$ genes are known in the art. For example, one of the most complex polymorphisms in the $V_H$ locus belongs to the $V_H$1-69 gene. The human $V_H$1-69 gene has 13 reported alleles (Sasso et al., 1993, A fetally expressed immunoglobulin $V_H$1 gene belongs to a complex set of alleles, Journal of Clinical Investigation 91:2358-2367; Sasso et al., 1996, Expression of the immunoglobulin $V_H$ gene 51p1 is proportional to its germline gene copy number, Journal of Clinical Investigation 97(9):2074-2080) and exists in at least three haplotypes that carry duplications of the $V_H$1-69 gene, which results in multiple copies of the $V_H$ gene at a given locus. These polymorphic alleles include differences in the complementarity determining regions (CDRs), which may dramatically influence antigen specificity. Table 2 sets for the reported alleles for human $V_H$1-69 and human $V_H$1-2 genes and the SEQ ID NOs for the DNA and protein sequences of the mature heavy chain variable regions.

Representative genomic DNA and full-length protein sequences of a $V_H$1-69 gene are set forth in SEQ ID NO: 4 and SEQ ID NO: 5, respectively. FIG. 5 and FIG. 6 set forth DNA and protein alignments of thirteen reported $V_H$1-69 alleles, respectively. Representative DNA and protein sequences of a $V_H$1-2 gene are set forth in SEQ ID NO: 63 and SEQ ID NO: 64, respectively. FIG. 8 and FIG. 9 set forth DNA and protein alignments of five reported $V_H$1-2 alleles, respectively. FIG. 7 and FIG. 10 set forth a percent identity/similarity matrix for aligned protein sequences corresponding to thirteen-reported human $V_H$1-69 and five reported human $V_H$1-2 alleles, respectively. In various embodiments, the modified locus of the invention comprises a $V_H$ gene selected from Table 1, present in two or more copy number, wherein the copy number includes up to and including the number of alleles shown in Table 1. In one embodiment, the modified locus of the invention comprises a $V_H$1-69 or $V_H$1-2 gene selected from Table 2, present in two or more copy number, wherein the copy number includes up to and including the number of alleles shown in Table 1.

TABLE 1

| V_H Family | V_H Gene | Alleles |
|---|---|---|
| V_H Family 1 | 1-2 | 5 |
| | 1-3 | 2 |
| | 1-8 | 2 |
| | 1-18 | 3 |
| | 1-24 | 1 |
| | 1-45 | 3 |
| | 1-46 | 3 |
| | 1-58 | 2 |
| | 1-69 | 13 |
| V_H Family 2 | 2-5 | 10 |
| | 2-26 | 1 |
| | 2-70 | 13 |
| V_H Family 3 | 3-7 | 3 |
| | 3-9 | 2 |
| | 3-11 | 4 |
| | 3-13 | 4 |
| | 3-15 | 8 |
| | 3-16 | 2 |
| | 3-20 | 1 |
| | 3-21 | 4 |
| | 3-23 | 5 |
| | 3-30 | 19 |
| | 3-30-3 | 2 |
| | 3-30-5 | 1 |
| | 3-33 | 6 |
| | 3-35 | 1 |
| | 3-38 | 2 |
| | 3-43 | 2 |
| | 3-48 | 4 |
| | 3-49 | 5 |
| | 3-53 | 4 |
| | 3-64 | 5 |
| | 3-66 | 4 |
| | 3-72 | 2 |
| | 3-73 | 2 |
| | 3-74 | 3 |
| V_H Family 4 | 4-4 | 7 |
| | 4-28 | 6 |
| | 4-30-1 | 1 |
| | 4-30-2 | 5 |
| | 4-30-4 | 6 |
| | 4-31 | 10 |
| | 4-34 | 13 |
| | 4-39 | 7 |
| | 4-59 | 10 |
| | 4-61 | 8 |
| V_H Family 5 | 5-51 | 5 |
| V_H Family 6 | 6-1 | 2 |
| V_H Family 7 | 7-4-1 | 5 |
| | 7-81 | 1 |

TABLE 2

| | Accession number | SEQ ID NO: (DNA/Protein) |
|---|---|---|
| IgHV1-69 Allele | | |
| IgHV1-69*01 | L22582 | 37/38 |
| IgHV1-69*02 | Z27506 | 39/40 |
| IgHV1-69*03 | X92340 | 41/42 |
| IgHV1-69*04 | M83132 | 43/44 |
| IgHV1-69*05 | X67905 | 45/46 |
| IgHV1-69*06 | L22583 | 47/48 |
| IgHV1-69*07 | Z29978 | 49/50 |
| IgHV1-69*08 | Z14309 | 51/52 |
| IgHV1-69*09 | Z14307 | 53/54 |
| IgHV1-69*10 | Z14300 | 55/56 |
| IgHV1-69*11 | Z14296 | 57/58 |
| IgHV1-69*12 | Z14301 | 59/60 |
| IgHV1-69*13 | Z14214 | 61/62 |

TABLE 2-continued

| | Accession number | SEQ ID NO: (DNA/Protein) |
|---|---|---|
| IgHV1-2 Allele | | |
| IgHV1-2*01 | X07448 | 63/64 |
| IgHV1-2*02 | X62106 | 65/66 |
| IgHV1-2*03 | X92208 | 67/68 |
| IgHV1-2*04 | Z12310 | 69/70 |
| IgHV1-2*05 | HM855674 | 71/72 |

Antigen-Dependent Heavy Chain Variable Gene Usage

Antigen-dependent preferential usage of $V_H$ genes can be exploited in the development of human therapeutics targeting clinically significant antigens. The ability to generate a repertoire of antibody variable domains using a particular $V_H$ gene can provide a significant advantage in the search for high-affinity antibody variable domains to use in human therapeutics. Studies on naive mouse and human $V_H$ gene usage in antibody variable domains reveal that most heavy chain variable domains are not derived from any particularly single or dominantly used $V_H$ gene. On the other hand, studies of antibody response to certain antigens reveal that in some cases a particular antibody response displays a biased usage of a particular $V_H$ gene in the B cell repertoire following immunization.

Although the human $V_H$ repertoire is quite diverse, by some estimates the expected frequency of usage of any given $V_H$ gene, assuming random selection of $V_H$ genes, is about 2% (Brezinschek et al., 1995, Analysis of the Heavy Chain Repertoire of Human Peripheral B Cells Using Single-Cell Polymerase Chain Reaction, J. Immunol. 155: 190-202). But $V_H$ usage in peripheral B cells in humans is skewed. In one study, functional V gene abundance followed the pattern $V_H3>V_H4>V_H1>V_H2>V_H5>V_H6$ (Davidkova et al., 1997, Selective Usage of $V_H$ Genes in Adult Human Lymphocyte Repertoires, Scand. J. Immunol. 45:62-73). One early study estimated that $V_H3$ family usage frequency was about 0.65, whereas $V_H1$ family usage frequency was about 0.15; these and other observations suggest that the germline complexity of the human $V_H$ repertoire is not precisely reflected in the peripheral B cell compartment in humans that have a normal germline $V_H$ repertoire, a situation that is similar to that observed in the mouse—i.e., $V_H$ gene expression is non-stochastic (Zouali and These, 1991, Probing $V_H$ Gene-Family Utilization in Human Peripheral B Cells by In Situ Hybridization, J. Immunol. 146(8):2855-2864). According to one report, $V_H$ gene usage in humans, from greatest to least, is $V_H3>V_H4>V_H1>V_H5>V_H2>V_H6$; rearrangements in peripheral B cells reveal that $V_H3$ family usage is higher than to be expected based on the relative number of germline $V_H3$ genes (Brezinschek et al., 1995). According to another report $V_H$ usage in humans follows the pattern $V_H3>V_H5>V_H2>V_H1>V_H4>V_H6$, based on analysis of pokeweed mitogen-activated peripheral small immunocompetent B cells (Davidkova et al., 1997, Selective Usage of $V_H$ Genes in Adult Human B Lymphocyte Repertoires, Scand. J. Immunol. 45:62-73). One report asserts that among the most frequently used $V_H3$ family members are 3-23, 3-30 and 3-54 (Brezinschek et al., 1995). In the $V_H4$ family, member 4-59 and 4-4b were found relatively more frequently (Id.), as well as 4-39 and 4-34 (Brezinscheck et al., 1997, Analysis of the Human $V_H$ Gene Repertoire, J. Clin. Invest. 99(10):2488-2501). Others postulate that the activated heavy chain repertoire is skewed in favor of high $V_H5$ expression and lower $V_H3$ expression (Van Dijk-Hard and Lundkvist, 2002, Long-term kinetics of adult human antibody repertoires, *Immunology* 107:136-144). Other studies assert that the most commonly used $V_H$ gene in the adult human repertoire is $V_H$4-59, followed by $V_H$3-23 and $V_H$3-48 (Arnaout et al., 2001, High-Resolution Description of Antibody Heavy-Chain Repertoires in Humans, *PLoS ONE* 6(8):108). Although usage studies are based on relatively small sample numbers and thus exhibit high variance, taken together the studies suggest that V gene expression is not purely stochastic. Indeed, studies with particular antigens have established that—in certain cases—the deck is firmly stacked against certain usages and in favor of others.

Over time, it became apparent that the observed repertoire of human heavy chain variable domains generated in response to certain antigens is highly restricted. Some antigens are associated almost exclusively with neutralizing antibodies having only certain particular $V_H$ genes, in the sense that effective neutralizing antibodies are derived from essentially only one $V_H$ gene. Such is the case for a number of clinically important human pathogens.

$V_H$1-69-derived heavy chains have been observed in a variety of antigen-specific antibody repertoires of therapeutic significance. For instance, $V_H$1-69 was frequently observed in heavy chain transcripts of an IgE repertoire of peripheral blood lymphocytes in young children with atopic disease (Bando et al., 2004, Characterization of $V_H\varepsilon$ gene expressed in PBL from children with atopic diseases: detection of homologous $V_H$1-69 derived transcripts from three unrelated patients, *Immunology Letters* 94:99-106). $V_H$1-69-derived heavy chains with a high degree of somatic hypermutation also occur in B cell lymphomas (Perez et al., 2009, Primary cutaneous B-cell lymphoma is associated with somatically hypermutated immunoglobulin variable genes and frequent use of $V_H$1-69 and $V_H$4-59 segments, *British Journal of Dermatology* 162:611-618), whereas some $V_H$1-69-derived heavy chains with essentially germline sequences (i.e., little to no somatic hypermutation) have been observed among autoantibodies in patients with blood disorders (Pos et al., 2008, $V_H$1-69 germline encoded antibodies directed towards ADAMTS13 in patients with acquired thrombotic thrombocytopenic purpura, *Journal of Thrombosis and Haemostasis* 7:421-428).

Further, neutralizing antibodies against viral antigens such as HIV, influenza and hepatitis C (HCV) have been found to utilize germline and/or somatically mutated $V_H$1-69-derived sequences (Miklos et al., 2000, Salivary gland mucosa-associated lymphoid tissue lymphoma immunoglobulin $V_H$ genes show frequent use of V1-69 with distinctive CDR3 features, *Blood* 95(12):3878-3884; Kunert et al., 2004, Characterization of molecular features, antigen-binding, and in vitro properties of IgG and IgM variants of 4E10, an anti-HIV type 1 neutralizing monoclonal antibody, *Aids Research and Human Retroviruses* 20(7):755-762; Chan et al., 2001, $V_H$1-69 gene is preferentially used by hepatitis C virus-associated B cell lymphomas and by normal B cells responding to the E2 viral antigen, *Blood* 97(4):1023-1026; Carbonari et al., 2005, Hepatitis C virus drives the unconstrained monoclonal expansion of $V_H$1-69-expressing memory B cells in type II cryoglobulinemia: A model of infection-driven lymphomagenesis, *Journal of Immunology* 174:6532-6539; Wang and Palese, 2009, Universal epitopes of influenza virus hemagglutinins?, *Nature Structural & Molecular Biology* 16(3):233-234; Sui et al., 2009, Structural and functional bases for broad-spectrum neutralization of avian and human influenza A viruses, *Nature Structural & Molecular Biology* 16(3):265-273; Maresca et al., 2001, Immunoglobulin Gene Mutations and Frequent Use of $V_H$1-69 and $V_H$4-34 Segments in Hepatitis C Virus-Positive and Hepatitis C Virus-Negative Nodal Marginal Zone B-Cell Lymphoma, *Am. J. Pathol.* 159(1):253-261).

$V_H$ usage bias is also observed in the humoral immune response to *Haemophilus influenzae* type b (Hib PS) in humans. Studies suggest that the $V_H$III family (the $V_H$IIIb subfamily in particular, $V_H$9.1) exclusively characterizes the human humoral response to Hib PS, with diverse D and J genes (Adderson et al., 1991, Restricted Ig H Chain V Gene Usage in the Human Antibody Response to *Haemophilus influenzae* Type b Capsular Polysaccharide, *J. Immunol.* 147(5):1667-1674; Adderson et al., 1993, Restricted Immunoglobulin $V_H$ Usage and VDJ Combinations in the Human Response to *Haemophilus influenzae* Type b Capsular Polysaccharide, *J. Clin. Invest.* 91:2734-2743). Human $J_H$ genes also display biased usage; $J_H$4 and $J_H$6 are observed at about 38-41% in peripheral B cells in humans (Brezinschek et al., 1995).

$V_H$ usage in HIV-1-infected humans is biased against $V_H$3 usage and in favor of $V_H$1 and $V_H$4 gene families (Wisnewski et al., 1996, Human Antibody Variable Region Gene Usage in HIV-1 Infection, *J. Acquired Immune Deficiency Syndromes & Human Retrovirology* 11(1):31-38). However, cDNA analysis of bone marrow from affected patients revealed significant $V_H$3 usage not expressed in the functional B cell repertoire, where Fabs reflecting the $V_H$3 usage exhibited effective in vitro neutralization of HIV-1 (Id.). It might be postulated that the humoral immune response to HIV-1 infection is possibly attenuated due to the $V_H$ restriction; modified non-human animals as described herein (not infectible by HIV-1) might thus be useful for generating neutralizing antibody domains derived from particular $V_H$ genes present in the genetically modified animals described herein, but derived from different $V_H$ genes than those observed in the restricted repertoire of affected humans.

Thus, the ability to generate high affinity human antibody variable domains in $V_H$-restricted mice, e.g., (restricted, e.g., to a $V_H$3 family member and polymorph(s) thereof) immunized with HIV-1 might provide a rich resource for designing effective HIV-1-neutralizing human therapeutics by thoroughly mining the restricted (e.g., restricted to a $V_H$3 family member or variant(s) thereof) repertoire of such an immunized mouse.

Restriction of the human antibody response to certain pathogens may reduce the likelihood of obtaining antibody variable regions from affected humans that can serve as springboards for designing high affinity neutralizing antibodies against the pathogen. For example, the human immune response to HIV-1 infection is clonally restricted throughout HIV-1 infection and into AIDS progression (Muller et al., 1993, B-cell abnormalities in AIDS: stable and clonally restricted antibody response in HIV-1 infection, *Scand. J. Immunol.* 38:327-334; Wisnewski et al., 1996). Further, $V_H$ genes are in general not present in all polymorphic forms in individuals; certain individuals in certain populations possess one variant, whereas individuals in other populations possess a different variant. Thus, the availability of a biological system that is restricted to a single $V_H$ gene and its variants will in various embodiments provide a hitherto unexploited source of diversity for generating antibody variable regions (e.g., human heavy and light cognate domains) based on a restricted $V_H$ gene.

Genetically modified mice that express human heavy chain variable regions with restricted $V_H$ gene segment usage are useful to generate a relatively large repertoire of junctionally diverse, combinatorially diverse, and somatically mutated high affinity human immunoglobulin heavy chain variable regions from an otherwise restricted repertoire. A restricted repertoire, in this instance, refers to a predetermined limitation in germline genes that results in the mouse being unable to form a rearranged heavy chain gene that is derived from any V gene other than a preselected V gene. In embodiments that employ a preselected V gene but not a preselected D and/or J gene, the repertoire is restricted with respect to the identity of the V gene but not the D and/or J gene. The identity of the preselected V gene (and any preselected D and/or J genes) is not limited to any particular V gene.

Designing a mouse so that it rearranges a single $V_H$ gene (present as a single segment or a set of variants) with a variety of human D and J gene segments (e.g., $D_H$ and $J_H$ segments) provides an in vivo junctional diversity/combinatorial diversity/somatic hypermutation permutation machine that can be used to iterate mutations in resulting rearranged heavy chain variable region sequences (e.g., V/D/J or V/J, as the case may be). In such a mouse, the clonal selection process operates to select suitable variable regions that bind an antigen of interest that are based on a single preselected $V_H$ gene (or variants thereof). Because the mouse's clonal selection components are dedicated to selection based on the single preselected $V_H$ gene segment, background noise is largely eradicated. With judicious selection of the $V_H$ gene segment, a relatively larger number of clonally selected, antigen-specific antibodies can be screened in a shorter period of time than with a mouse with a large diversity of V segments.

Preselecting and restricting a mouse to a single V segment provides a system for permuting V/D/J junctions at a rate that is in various embodiments higher than that observed in mice that otherwise have up to 40 or more V segments to recombine with D and J regions. Removal of other V segments frees the locus to form more V/D/J combinations for the preselected V segment than otherwise observed. The increased number of transcripts that result from the recombination of the preselected V with one of a plurality of D and one of a plurality of J segments will feed those transcripts into the clonal selection system in the form of pre-B cells, and the clonal selection system is thus dedicated to cycling B cells that express the preselected V region. In this way, more unique V regions derived from the preselected V segment can be screened by the organism than would otherwise be possible in a given amount of time.

In various aspects, mice are described that enhance the junctional diversity of V/D recombinations for the preselected V region, because all or substantially all recombinations of the immunoglobulin heavy chain variable locus will be of the preselected V segment and the D and J segments that are placed in such mice. Therefore, the mice provide a method for generating a diversity of CDR3 segments using a base, or restricted $V_H$ gene repertoire.

Genomic Location and Function of Mouse ADAM6

Male mice that lack the ability to express any functional ADAM6 protein surprisingly exhibit a defect in the ability of the mice to mate and to generate offspring. The mice lack the ability to express a functional ADAM6 protein by virtue of a replacement of all or substantially all mouse immunoglobulin variable region gene segments with human variable region gene segments. The loss of ADAM6 function results because the ADAM6 locus is located within a region of the endogenous mouse immunoglobulin heavy chain variable region gene locus, proximal to the 3' end of the $V_H$ gene segment locus that is upstream of the $D_H$ gene segments. In order to breed mice that are homozygous for a replacement of all or substantially all endogenous mouse heavy chain variable sequences with a restricted human heavy chain sequence, it is generally a cumbersome approach to set up males and females that are each homozygous for the restricted human heavy chain sequence and await a productive mating. Successful litters are low in frequency and size. Instead, males heterozygous for the restricted human heavy chain sequence have been employed to mate with females homozygous for the replacement to generate progeny that are heterozygous for the restricted human heavy chain sequence, then a homozygous mouse is bred therefrom. The inventors have determined that the likely cause of the loss in fertility in the male mice is the absence in homozygous male mice of a functional ADAM6 protein.

In various aspects, male mice that comprise a damaged (i.e., nonfunctional or marginally functional) ADAM6 gene exhibit a reduction or elimination of fertility. Because in mice (and other rodents) the ADAM6 gene is located in the immunoglobulin heavy chain locus, the inventors have determined that in order to propagate mice, or create and maintain a strain of mice, that comprise a humanized immunoglobulin heavy chain locus, various modified breeding or propagation schemes are employed. The low fertility, or infertility, of male mice homozygous for a humanized immunoglobulin heavy chain variable gene locus renders maintaining such a modification in a mouse strain difficult. In various embodiments, maintaining the strain comprises avoiding infertility problems exhibited by male mice homozygous for the humanized heavy chain locus.

In one aspect, a method for maintaining a strain of mouse as described herein is provided. The strain of mouse need not comprise an ectopic ADAM6 sequence, and in various embodiments the strain of mouse is homozygous or heterozygous for a knockout (e.g., a functional knockout) of ADAM6.

The mouse strain comprises a modification of an endogenous immunoglobulin heavy chain locus that results in a reduction or loss in fertility in a male mouse. In one embodiment, the modification comprises a deletion of a regulatory region and/or a coding region of an ADAM6 gene. In a specific embodiment, the modification comprises a modification of an endogenous ADAM6 gene (regulatory and/or coding region) that reduces or eliminates fertility of a male mouse that comprises the modification; in a specific embodiment, the modification reduces or eliminates fertility of a male mouse that is homozygous for the modification.

In one embodiment, the mouse strain is homozygous or heterozygous for a knockout (e.g., a functional knockout) or a deletion of an ADAM6 gene.

In one embodiment, the mouse strain is maintained by isolating from a mouse that is homozygous or heterozygous for the modification a cell, and employing the donor cell in host embryo, and gestating the host embryo and donor cell in a surrogate mother, and obtaining from the surrogate mother a progeny that comprises the genetic modification. In one embodiment, the donor cell is an ES cell. In one embodiment, the donor cell is a pluripotent cell, e.g., an induced pluripotent cell.

In one embodiment, the mouse strain is maintained by isolating from a mouse that is homozygous or heterozygous for the modification a nucleic acid sequence comprising the modification, and introducing the nucleic acid sequence into a host nucleus, and gestating a cell comprising the nucleic acid sequence and the host nucleus in a suitable animal. In one embodiment, the nucleic acid sequence is introduced into a host oocyte embryo.

In one embodiment, the mouse strain is maintained by isolating from a mouse that is homozygous or heterozygous for the modification a nucleus, and introducing the nucleus into a host cell, and gestating the nucleus and host cell in a suitable animal to obtain a progeny that is homozygous or heterozygous for the modification.

In one embodiment, the mouse strain is maintained by employing in vitro fertilization (IVF) of a female mouse (wild-type, homozygous for the modification, or heterozygous for the modification) employing a sperm from a male mouse comprising the genetic modification. In one embodiment, the male mouse is heterozygous for the genetic modification. In one embodiment, the male mouse is homozygous for the genetic modification.

In one embodiment, the mouse strain is maintained by breeding a male mouse that is heterozygous for the genetic modification with a female mouse to obtain progeny that comprises the genetic modification, identifying a male and a female progeny comprising the genetic modification, and employing a male that is heterozygous for the genetic modification in a breeding with a female that is wild-type, homozygous, or heterozygous for the genetic modification to obtain progeny comprising the genetic modification. In one embodiment, the step of breeding a male heterozygous for the genetic modification with a wild-type female, a female heterozygous for the genetic modification, or a female homozygous for the genetic modification is repeated in order to maintain the genetic modification in the mouse strain.

In one aspect, a method is provided for maintaining a mouse strain that comprises a replacement of an endogenous immunoglobulin heavy chain variable gene locus with one or more human immunoglobulin heavy chain sequences, comprising breeding the mouse strain so as to generate heterozygous male mice, wherein the heterozygous male mice are bred to maintain the genetic modification in the strain. In a specific embodiment, the strain is not maintained by any breeding of a homozygous male with a wild-type female, or a female homozygous or heterozygous for the genetic modification.

The ADAM6 protein is a member of the A Disintegrin And Metalloprotease (ADAM) family of proteins, which is a large family of proteins having diverse functions including cell adhesion. Some members of the ADAM family are implicated in spermatogenesis and fertilization. For example, ADAM2 encodes a subunit of the protein fertilin, which is implicated in sperm-egg interactions. ADAM3, or cyritestin, appears necessary for sperm binding to the zona pellucida. The absence of either ADAM2 or ADAM3 results in infertility. It has been postulated that ADAM2, ADAM3, and ADAM6 form a complex on the surface of mouse sperm cells. The human counterpart gene (human ADAM6), normally found between human $V_H$ gene segments $V_H1$-2 and $V_H6$-1 in the human immunoglobulin heavy chain locus, appears to be a pseudogene. In mice, there are two ADAM6 genes—ADAM6a and ADAM6b—that are found in an intergenic region between mouse $V_H$ and $D_H$ gene segments, and in the mouse the ADAM6a and ADAM6b genes are oriented in opposite transcriptional orientation to that of the surrounding immunoglobulin gene segments. In mice, a functional ADAM6 locus is apparently required for normal fertilization. A functional ADAM6 locus or sequence, then, refers to an ADAM6 locus or sequence that can complement, or rescue, the drastically reduced fertilization exhibited in male mice with missing or nonfunctional endogenous ADAM6 loci.

The position of the intergenic sequence in mice that encodes ADAM6a and ADAM6b renders the intergenic sequence susceptible to modification when modifying an endogenous mouse heavy chain. When $V_H$ gene segments are deleted or replaced, or when $D_H$ gene segments are deleted or replaced, there is a high probability that a resulting mouse will exhibit a severe deficit in fertility. In order to compensate for the deficit, the mouse is modified to include a nucleotide sequence that encodes a protein that will complement the loss in ADAM6 activity due to a modification of the endogenous mouse ADAM6 locus. In various embodiments, the complementing nucleotide sequence is one that encodes a mouse ADAM6a, a mouse ADAM6b, or a homolog or ortholog or functional fragment thereof that rescues the fertility deficit. Alternatively, suitable methods to preserve the endogenous ADAM6 locus can be employed, while rendering the endogenous immunoglobulin heavy chain sequences flanking the mouse ADAM6 locus incapable of rearranging to encode a functional endogenous heavy chain variable region. Exemplary alternative methods include manipulation of large portions of mouse chromosomes that position the endogenous immunoglobulin heavy chain variable region loci in such a way that they are incapable of rearranging to encode a functional heavy chain variable region that is operably linked to an endogenous heavy chain constant gene. In various embodiments, the methods include inversions and/or translocations of mouse chromosomal fragments containing endogenous immunoglobulin heavy chain gene segments.

The nucleotide sequence that rescues fertility can be placed at any suitable position. It can be placed in the intergenic region, or in any suitable position in the genome (i.e., ectopically). In one embodiment, the nucleotide sequence can be introduced into a transgene that randomly integrates into the mouse genome. In one embodiment, the sequence can be maintained episomally, that is, on a separate nucleic acid rather than on a mouse chromosome. Suitable positions include positions that are transcriptionally permissive or active, e.g., a ROSA26 locus (Zambrowicz et al., 1997, *PNAS USA* 94:3789-3794), a BT-5 locus (Michael et al., 1999, *Mech. Dev.* 85:35-47), or an Oct4 locus (Wallace et al., 2000, *Nucleic Acids Res.* 28:1455-1464). Targeting nucleotide sequences to transcriptionally active loci are described, e.g., in U.S. Pat. No. 7,473,557, herein incorporated by reference.

Alternatively, the nucleotide sequence that rescues fertility can be coupled with an inducible promoter so as to facilitate optimal expression in the appropriate cells and/or tissues, e.g., reproductive tissues. Exemplary inducible promoters include promoters activated by physical (e.g., heat shock promoter) and/or chemical means (e.g., IPTG or Tetracycline).

Further, expression of the nucleotide sequence can be linked to other genes so as to achieve expression at specific stages of development or within specific tissues. Such expression can be achieved by placing the nucleotide sequence in operable linkage with the promoter of a gene expressed at a specific stage of development. For example, immunoglobulin sequences from one species engineered into the genome of a host species are place in operable linkage with a promoter sequence of a CD19 gene (a B cell specific gene) from the host species. B cell-specific expression at precise developmental stages when immunoglobulins are expressed is achieved.

Yet another method to achieve robust expression of an inserted nucleotide sequence is to employ a constitutive promoter. Exemplary constitutive promoters include SV40, CMV, UBC, EF1A, PGK and CAGG. In a similar fashion, the desired nucleotide sequence is placed in operable linkage with a selected constitutive promoter, which provides high level of expression of the protein(s) encoded by the nucleotide sequence.

The term "ectopic" is intended to include a displacement, or a placement at a position that is not normally encountered in nature (e.g., placement of a nucleic acid sequence at a position that is not the same position as the nucleic acid sequence is found in a wild-type mouse). The term, in various embodiments, is used in the sense of its object being out of its normal, or proper, position. For example, the phrase "an ectopic nucleotide sequence encoding . . . " refers to a nucleotide sequence that appears at a position at which it is not normally encountered in the mouse. For example, in the case of an ectopic nucleotide sequence encoding a mouse ADAM6 protein (or an ortholog or homolog or fragment thereof that provides the same or similar fertility benefit on male mice), the sequence can be placed at a different position in the mouse's genome than is normally found in a wild-type mouse. In such cases, novel sequence junctions of mouse sequence will be created by placing the sequence at a different position in the mouse's genome than in a wild-type mouse. A functional homolog or ortholog of mouse ADAM6 is a sequence that confers a rescue of fertility loss (e.g., loss of the ability of a male mouse to generate offspring by mating) that is observed in an ADAM6$^{-/-}$ mouse. Functional homologs or orthologs include proteins that have at least about 89% identity or more, e.g., up to 99% identity, to the amino acid sequence of ADAM6a and/or to the amino acid sequence of ADAM6b, and that can complement, or rescue ability to successfully mate, of a mouse that has a genotype that includes a deletion or knockout of ADAM6a and/or ADAM6b.

The ectopic position can be anywhere (e.g., as with random insertion of a transgene containing a mouse ADAM6 sequence), or can be, e.g., at a position that approximates (but is not precisely the same as) its location in a wild-type mouse (e.g., in a modified endogenous mouse immunoglobulin locus, but either upstream or downstream of its natural position, e.g., within a modified immunoglobulin locus but between different gene segments, or at a different position in a mouse V-D intergenic sequence). One example of an ectopic placement is maintaining the position normally found in wild-type mice within the endogenous immunoglobulin heavy chain locus while rendering the surrounding endogenous heavy chain gene segments incapable of rearranging to encode a functional heavy chain containing an endogenous heavy chain constant region. In this example, this may be accomplished by inversion of the chromosomal fragment containing the endogenous immunoglobulin heavy chain variable loci, e.g. using engineered site-specific recombination sites placed at positions flanking the variable region locus. Thus, upon recombination the endogenous heavy chain variable region loci are placed at a great distance away from the endogenous heavy chain constant region genes thereby preventing rearrangement to encode a functional heavy chain containing an endogenous heavy chain constant region. Other exemplary methods to achieve functional silencing of the endogenous immunoglobulin heavy chain variable gene locus while maintaining a functional ADAM6 locus will apparent to persons of skill upon reading this disclosure and/or in combination with methods known in the art. With such a placement of the endogenous heavy chain locus, the endogenous ADAM6 genes are maintained and the endogenous immunoglobulin heavy chain locus is functionally silenced.

Another example of an ectopic placement is placement within a humanized immunoglobulin heavy chain locus. For example, a mouse comprising a replacement of one or more endogenous $V_H$ gene segments with a single human $V_H$ gene segment, wherein the replacement removes an endogenous ADAM6 sequence, can be engineered to have a mouse ADAM6 sequence located within an intergenic sequence that lies between the single human $V_H$ gene segment and a human $D_H$ gene segment. Another example of an ectopic placement is placement of the mouse ADAM6 sequence at a position 5' (with respect to the direction of transcription of the single human $V_H$ gene segment) to the human $V_H$ gene segment. A position 5' to the single human VH gene segment may be in close proximity, e.g., a few hundred base pairs to a few kb, or distant, e.g., several kb to hundreds of kb or even a megabase or greater, relative to the human $V_H$ gene segment. The resulting modification would generate a (ectopic) mouse ADAM6 sequence within or contiguous, or even on the same chromosome, with a human gene sequence, and the (ectopic) placement of the mouse ADAM6 sequence within the human gene sequence can approximate the position of the mouse ADAM6 sequence (i.e., within the V-D intergenic region). The resulting sequence junctions created by the joining of a (ectopic) mouse ADAM6 sequence within or adjacent to a human gene sequence (e.g., an immunoglobulin gene sequence) within the germline of the mouse would be novel as compared to the same or similar position in the genome of a wild-type mouse.

In various embodiments, non-human animals are provided that lack an ADAM6 or ortholog or homolog thereof, wherein the lack renders the non-human animal infertile, or substantially reduces fertility of the non-human animal. In various embodiments, the lack of ADAM6 or ortholog or homolog thereof is due to a modification of an endogenous immunoglobulin heavy chain locus. A substantial reduction in fertility is, e.g., a reduction in fertility (e.g., breeding frequency, pups per litter, litters per year, etc.) of about 50%, 60%, 70%, 80%, 90%, or 95% or more. In various embodiments, the non-human animals are supplemented with a mouse ADAM6 gene or ortholog or homolog or functional fragment thereof that is functional in a male of the non-human animal, wherein the supplemented ADAM6 gene or ortholog or homolog or functional fragment thereof rescues the reduction in fertility in whole or in substantial part. A rescue of fertility in substantial part is, e.g., a restoration of fertility such that the non-human animal exhibits a fertility that is at least 70%, 80%, or 90% or more as compared with an unmodified (i.e., an animal without a modification to the ADAM6 gene or ortholog or homolog thereof) heavy chain locus.

The sequence that confers upon the genetically modified animal (i.e., the animal that lacks a functional ADAM6 or ortholog or homolog thereof, due to, e.g., a modification of a immunoglobulin heavy chain locus) is, in various embodiments, selected from an ADAM6 gene or ortholog or homolog thereof. For example, in a mouse, the loss of ADAM6 function is rescued by adding, in one embodiment, a mouse ADAM6 gene. In one embodiment, the loss of ADAM6 function in the mouse is rescued by adding an ortholog or homolog of a closely related specie with respect to the mouse, e.g., a rodent, e.g., a mouse of a different strain or species, a rat of any species, a rodent; wherein the addition of the ortholog or homolog to the mouse rescues the loss of fertility due to loss of ADAM6 function or loss of an ADAM6 gene. Orthologs and homologs from other species, in various embodiments, are selected from a phylogenetically related species and, in various embodiments, exhibit a percent identity with the endogenous ADAM6 (or ortholog) that is about 80% or more, 85% or more, 90% or more, 95% or more, 96% or more, or 97% or more; and that rescue ADAM6-related or (in a non-mouse) ADAM6 ortholog-related loss of fertility. For example, in a genetically modified male rat that lacks ADAM6 function (e.g., a rat with an endogenous immunoglobulin heavy chain variable region replaced with a human immunoglobulin heavy chain variable region, or a knockout in the rat immunoglobulin heavy chain region), loss of fertility in the rat is rescued by addition of a rat ADAM6 or, in some embodiments, an ortholog of a rat ADAM6 (e.g., an ADAM6 ortholog from another rat strain or species, or, in one embodiment, from a mouse).

Thus, in various embodiments, genetically modified animals that exhibit no fertility or a reduction in fertility due to modification of a nucleic acid sequence encoding an ADAM6 protein (or ortholog or homolog thereof) or a regulatory region operably linked with the nucleic acid sequence, comprise a nucleic acid sequence that complements, or restores, the loss in fertility where the nucleic acid sequence that complements or restores the loss in fertility is from a different strain of the same species or from a phylogenetically related species. In various embodiments, the complementing nucleic acid sequence is an ADAM6 ortholog or homolog or functional fragment thereof. In various embodiments, the complementing ADAM6 ortholog or homolog or functional fragment thereof is from a non-human animal that is closely related to the genetically modified animal having the fertility defect. For example, where the genetically modified animal is a mouse of a particular strain, an ADAM6 ortholog or homolog or functional fragment thereof can be obtained from a mouse of another strain, or a mouse of a related species. In one embodiment, where the genetically modified animal comprising the fertility defect is of the order Rodentia, the ADAM6 ortholog or homolog or functional fragment thereof is from another animal of the order Rodentia. In one embodiment, the genetically modified animal comprising the fertility defect is of a suborder Myomoropha (e.g., jerboas, jumping mice, mouse-like hamsters, hamsters, New World rats and mice, voles, true mice and rats, gerbils, spiny mice, crested rats, climbing mice, rock mice, white-tailed rats, malagasy rats and mice, spiny dormice, mole rats, bamboo rats, zokors), and the ADAM6 ortholog or homolog or functional fragment thereof is selected from an animal of order Rodentia, or of the suborder Myomorpha.

In one embodiment, the genetically modified animal is from the superfamily Dipodoidea, and the ADAM6 ortholog or homolog or functional fragment thereof is from the superfamily Muroidea. In one embodiment, the genetically modified animal is from the superfamily Muroidea, and the ADAM6 ortholog or homolog or functional fragment thereof is from the superfamily Dipodoidea.

In one embodiment, the genetically modified animal is a rodent. In one embodiment, the rodent is selected from the superfamily Muroidea, and the ADAM6 ortholog or homolog is from a different species within the superfamily Muroidea. In one embodiment, the genetically modified animal is from a family selected from Calomyscidae (e.g., mouse-like hamsters), Cricetidae (e.g., hamster, New World rats and mice, voles), Muridae (true mice and rats, gerbils, spiny mice, crested rats), Nesomyidae (climbing mice, rock mice, with-tailed rats, Malagasy rats and mice), Platacanthomyidae (e.g., spiny dormice), and Spalacidae (e.g., mole rates, bamboo rats, and zokors); and the ADAM6 ortholog or homolog is selected from a different species of the same family. In a specific embodiment, the genetically modified rodent is selected from a true mouse or rat (family Muridae), and the ADAM6 ortholog or homolog is from a species selected from a gerbil, spiny mouse, or crested rat. In one embodiment, the genetically modified mouse is from a member of the family Muridae, and the ADAM6 ortholog or homolog is from a different species of the family Muridae. In a specific embodiment, the genetically modified rodent is a mouse of the family Muridae, and the ADAM6 ortholog or homolog is from a rat, gerbil, spiny mouse, or crested rat of the family Muridae.

In various embodiments, one or more rodent ADAM6 orthologs or homologs or functional fragments thereof of a rodent in a family restores fertility to a genetically modified rodent of the same family that lacks an ADAM6 ortholog or homolog (e.g., Cricetidae (e.g., hamsters, New World rats and mice, voles); Muridae (e.g., true mice and rats, gerbils, spiny mice, crested rats)).

In various embodiments, ADAM6 orthologs, homologs, and fragments thereof are assessed for functionality by ascertaining whether the ortholog, homolog, or fragment restores fertility to a genetically modified male non-human animal that lacks ADAM6 activity (e.g., a rodent, e.g., a mouse or rat, that comprises a knockout of ADAM6 or its ortholog). In various embodiments, functionality is defined as the ability of a sperm of a genetically modified animal lacking an endogenous ADAM6 or ortholog or homolog thereof to migrate an oviduct and fertilize an ovum of the same specie of genetically modified animal.

In various aspects, mice that comprise deletions or replacements of the endogenous heavy chain variable region locus or portions thereof can be made that contain an ectopic nucleotide sequence that encodes a protein that confers similar fertility benefits to mouse ADAM6 (e.g., an ortholog or a homolog or a fragment thereof that is functional in a male mouse). The ectopic nucleotide sequence can include a nucleotide sequence that encodes a protein that is an ADAM6 homolog or ortholog (or fragment thereof) of a different mouse strain or a different species, e.g., a different rodent species, and that confers a benefit in fertility, e.g., increased number of litters over a specified time period, and/or increased number of pups per litter, and/or the ability of a sperm cell of a male mouse to traverse through a mouse oviduct to fertilize a mouse egg.

In one embodiment, the ADAM6 is a homolog or ortholog that is at least 89% to 99% identical to a mouse ADAM6 protein (e.g., at least 89% to 99% identical to mouse ADAM6a or mouse ADAM6b). In one embodiment, the ectopic nucleotide sequence encodes one or more proteins independently selected from a protein at least 89% identical to mouse ADAM6a, a protein at least 89% identical to mouse ADAM6b, and a combination thereof. In one embodiment, the homolog or ortholog is a rat, hamster, mouse, or guinea pig protein that is or is modified to be about 89% or more identical to mouse ADAM6a and/or mouse ADAM6b. In one embodiment, the homolog or ortholog is or is at least 90%, 91%, 92%, 93%, 94%, 95%, 96%, 97%, 98%, or 99% identical to a mouse ADAM6a and/or mouse ADAM6b.

Ectopic ADAM6 in Humanized Heavy Chain Mice

Developments in gene targeting, e.g., the development of bacterial artificial chromosomes (BACs), now enable the recombination of relatively large genomic fragments. BAC engineering has allowed for the ability to make large deletions, and large insertions, into mouse ES cells.

Mice that make human antibodies have been available for some time now. Although they represent an important advance in the development of human therapeutic antibodies, these mice display a number of significant abnormalities that limit their usefulness. For example, they display compromised B cell development. The compromised development may be due to a variety of differences between the transgenic mice and wild-type mice.

Human antibodies might not optimally interact with mouse pre B cell or B cell receptors on the surface of mouse cells that signal for maturation, proliferation, or survival during clonal selection. Fully human antibodies might not optimally interact with a mouse Fc receptor system; mice express Fc receptors that do not display a one-to-one correspondence with human Fc receptors. Finally, various mice that make fully human antibodies do not include all genuine mouse sequences, e.g., downstream enhancer elements and other locus control elements, which may be required for wild-type B cell development.

Mice that make fully human antibodies generally comprise endogenous immunoglobulin loci that are disabled in some way, and human transgenes that comprise variable and constant immunoglobulin gene segments are introduced into a random location in the mouse genome. As long as the endogenous locus is sufficiently disabled so as not to rearrange gene segments to form a functional immunoglobulin gene, the goal of making fully human antibodies in such a mouse can be achieved—albeit with compromised B cell development.

Although compelled to make fully human antibodies from the human transgene locus, generating human antibodies in a mouse is apparently an unfavored process. In some mice, the process is so unfavored as to result in formation of chimeric human variable/mouse constant heavy chains (but not light chains) through the mechanism of trans-switching. By this mechanism, transcripts that encode fully human antibodies undergo isotype switching in trans from the human isotype to a mouse isotype. The process is in trans, because the fully human transgene is located apart from the endogenous locus that retains an undamaged copy of a mouse heavy chain constant region gene. Although in such mice trans-switching is readily apparent the phenomenon is still insufficient to rescue B cell development, which remains frankly impaired. In any event, trans-switched antibodies made in such mice retain fully human light chains, since the phenomenon of trans-switching apparently does not occur with respect to light chains; trans-switching presumably relies on switch sequences in endogenous loci used (albeit differently) in normal isotype switching in cis. Thus, even when mice engineered to make fully human antibodies select a trans-switching mechanism to make antibodies with mouse constant regions, the strategy is still insufficient to rescue normal B cell development.

A primary concern in making antibody-based human therapeutics, e.g., anti-pathogen antibodies, is identifying useful variable domains that specifically recognize particular epitopes and bind them with a desirable affinity, usually—but not always—with high affinity. Mice as described herein, which contain a precise replacement of mouse immunoglobulin heavy chain variable regions with a restricted number of human immunoglobulin heavy chain variable gene segments at the endogenous mouse loci, display near wild-type B cell development and the variable regions generated in response to immunization are fully human, wherein the heavy chains are derived from a single human $V_H$ gene segment. Thus, such mice provide a platform to generate a panel of heavy chain complementary determining regions (CDRs) that are specifically directed to bind a given antigen, e.g., a pathogenic virus.

Mice as described herein contain a precise, large-scale replacement of germline variable gene loci of mouse immunoglobulin heavy chain (IgH) with a restricted human immunoglobulin heavy chain variable locus, and immunoglobulin light chain (e.g., κ light chain, Igκ) with an equivalent human immunoglobulin κ light chain variable gene locus, at the endogenous loci. This precise replacement results in a mouse with hybrid immunoglobulin loci that make heavy and light chains that have a human variable regions and a mouse constant region. The precise replacement of mouse $V_H$-$D_H$-$J_H$ and Vκ-Jκ segments leave flanking mouse sequences intact and functional at the hybrid immunoglobulin loci. The humoral immune system of the mouse functions like that of a wild-type mouse. B cell development is unhindered in any significant respect and a somatically mutated panel of human heavy chain CDRs is generated in the mouse upon antigen challenge.

Mice as described herein are possible because immunoglobulin gene segments for heavy and κ light chains rearrange similarly in humans and mice, which is not to say that their loci are the same or even nearly so—clearly they are not. However, the loci are similar enough that humanization of the heavy chain variable gene locus can be accomplished by replacing about three million base pairs of contiguous mouse sequence that contains all the $V_H$, $D_H$, and $J_H$ gene segments with a contiguous human genomic sequence containing a restricted human heavy chain locus.

In some embodiments, further replacement of certain mouse constant region gene sequences with human gene sequences (e.g., replacement of mouse $C_H1$ sequence with human $C_H1$ sequence, and replacement of mouse $C_L$ sequence with human $C_L$ sequence) results in mice with hybrid immunoglobulin loci that make antibodies that have human variable regions and partly human constant regions, suitable for, e.g., making fully human antibody fragments, e.g., fully human Fab's. Mice with hybrid immunoglobulin loci exhibit normal variable gene segment rearrangement, normal somatic hypermutation frequencies, and normal class switching. These mice exhibit a humoral immune system that is indistinguishable from wild type mice, and display normal cell populations at all stages of B cell development and normal lymphoid organ structures—even where the mice lack a full repertoire of human variable region gene segments. Immunizing these mice results in robust humoral responses that display a wide diversity of heavy chain CDRs and light chain variable gene segment usage.

The precise replacement of mouse germline variable region gene segments allows for making mice that have partly human immunoglobulin loci. Because the partly human immunoglobulin loci rearrange, hypermutate, and class switch normally, the partly human immunoglobulin loci generate antibodies in a mouse that comprise human variable regions. Nucleotide sequences that encode the variable regions can be identified and cloned, then fused (e.g., in an in vitro system) with any sequences of choice, e.g., any immunoglobulin isotype suitable for a particular use, resulting in an antibody or antigen-binding protein derived wholly from human sequences.

Large-scale humanization by recombineering methods were used to modify mouse embryonic stem (ES) cells to precisely replace up to three megabases of the mouse heavy chain immunoglobulin locus that included essentially all of the mouse $V_H$, $D_H$, and $J_H$ gene segments with a human genomic sequence containing a restricted human heavy chain locus including a single human $V_H$ gene segment, 27 human $D_H$ gene segments, and six human $J_H$ gene segments. Up to a one-half megabase segment of the human genome comprising one of two repeats encoding essentially all human Vκ and Jκ gene segments was used to replace a three megabase segment of the mouse immunoglobulin κ light chain locus containing essentially all of the mouse Vκ and Jκ gene segments.

Mice with such replaced immunoglobulin loci can comprise a disruption or deletion of the endogenous mouse ADAM6 locus, which is normally found between the 3'-most $V_H$ gene segment and the 5'-most $D_H$ gene segment at the mouse immunoglobulin heavy chain locus. Disruption in this region can lead to reduction or elimination of functionality of the endogenous mouse ADAM6 locus. If one, or both, of the 3'-most $V_H$ gene segments of the human heavy chain repertoire are used in construction of the restricted human heavy chain locus, an intergenic region containing a pseudogene that appears to be a human ADAM6 pseudogene is present between these $V_H$ gene segments, i.e., between human $V_H$1-2 and $V_H$1-6, However, male mice that comprise this human intergenic sequence exhibit a reduction in fertility (see U.S. Ser. No. 13/404,075, herein incorporated by reference).

Mice are described that comprise the restricted human heavy chain and equivalent human κ light chain loci as described above, and that also comprise an ectopic nucleic acid sequence encoding a mouse ADAM6, where the mice exhibit essentially normal fertility. In one embodiment, the ectopic nucleic acid sequence comprises a mouse ADAM6a and/or a mouse ADAM6b sequence or functional fragments thereof placed between a human $V_H$1-69 and a human $D_H$1-1 at a modified endogenous heavy chain locus. In one embodiment, the ectopic nucleic acid sequence is SEQ ID NO: 77, placed between a human $V_H$1-69 and a human $D_H$1-1 at a modified endogenous heavy chain locus. The direction of transcription of the ADAM6 genes of SEQ ID NO: 77 are opposite with respect to the direction of transcription of the surrounding human gene segments. In one embodiment, the ectopic nucleic acid sequence comprises a mouse ADAM6a and/or a mouse ADAM6b sequence or functional fragments thereof placed upstream (or 5') of a human $V_H$1-2 gene segment at a modified endogenous heavy chain locus. In one embodiment, the ectopic nucleic acid sequence is SEQ ID NO: 73, placed upstream (or 5') of a human $V_H$1-2 gene segment at a modified endogenous heavy chain locus. The direction of transcription of the ADAM6 genes of SEQ ID NO: 73 are opposite with respect to the direction of transcription of the surrounding human gene segments (e.g. a human $V_H$1-2 gene segment).

Although examples herein show rescue of fertility by placing the ectopic sequence between the indicated human gene segments, skilled persons will recognize that placement of the ectopic sequence at any suitable transcriptionally-permissive locus in the mouse genome (or even extrachromosomally) will be expected to similarly rescue fertility in a male mouse.

The phenomenon of complementing a mouse that lacks a functional ADAM6 locus with an ectopic sequence that comprises a mouse ADAM6 gene or ortholog or homolog or functional fragment thereof is a general method that is applicable to rescuing any mice with nonfunctional or minimally functional endogenous ADAM6 loci. Thus, a great many mice that comprise an ADAM6-disrupting modification of the immunoglobulin heavy chain locus can be rescued with the compositions and methods of the invention. Accordingly, the invention comprises mice with a wide variety of modifications of immunoglobulin heavy chain loci that compromise endogenous ADAM6 function. Some (non-limiting) examples are provided in this description. In addition to the mice described, the compositions and methods related to ADAM6 can be used in a great many applications, e.g., when modifying a heavy chain locus in a wide variety of ways.

In one aspect, a mouse is provided that comprises an ectopic ADAM6 sequence that encodes a functional ADAM6 protein (or ortholog or homolog or functional fragment thereof), a replacement of all or substantially all mouse $V_H$ gene segments with a single human $V_H$ gene segments, a replacement of all or substantially all mouse $D_H$ gene segments and $J_H$ gene segments with human $D_H$ and human $J_H$ gene segments; wherein the mouse lacks a $C_H1$ and/or hinge region. In one embodiment, the mouse makes a single variable domain binding protein that is a dimer of immunoglobulin chains selected from: (a) human $V_H$-mouse $C_H1$-mouse $C_H2$-mouse $C_H3$; (b) human $V_H$-mouse hinge-mouse $C_H2$-mouse $C_H3$; and, (c) human $V_H$-mouse $C_H2$-mouse $C_H3$.

In one aspect, the nucleotide sequence that rescues fertility is placed upstream (or 5') of a human immunoglobulin heavy chain variable region sequence (e.g., upstream of a human $V_H$1-2 or $V_H$1-69 gene segment) in a mouse that has a replacement of one or more mouse immunoglobulin heavy chain variable gene segments ($mV_H$'s, $mD_H$'s, and/or $mJ_H$'s) with one or more human immunoglobulin heavy chain variable gene segments ($hV_H$'s, $hD_H$'s, and/or $hJ_H$'s), and the mouse further comprises a replacement of one or more mouse immunoglobulin κ light chain variable gene segments (mVκ's and/or mJκ's) with one or more human immunoglobulin κ light chain variable gene segments (hVκ's and/or hJκ's).

In one aspect, the nucleotide sequence that rescues fertility is placed within a human immunoglobulin heavy chain variable region sequence (e.g., between human $V_H$1-69 or human $V_H$1-2 and a human $D_H$1-1 gene segment) in a mouse that has a replacement of one or more mouse immunoglobulin heavy chain variable gene segments ($mV_H$'s, $mD_H$'s, and/or $mJ_H$'s) with one or more human immunoglobulin heavy chain variable gene segments ($hV_H$'s, $hD_H$'s, and/or $hJ_H$'s), and the mouse further comprises a replacement of one or more mouse immunoglobulin κ light chain variable gene segments (mVκ's and/or mJκ's) with one or more human immunoglobulin κ light chain variable gene segments (hVκ's and/or hJκ's).

In one embodiment, the one or more mouse immunoglobulin heavy chain variable gene segments comprises about three megabases of the mouse immunoglobulin heavy chain locus. In one embodiment, the one or more mouse immunoglobulin heavy chain variable gene segments comprises at least 89 $V_H$ gene segments, at least 13 $D_H$ gene segments, at least four $J_H$ gene segments or a combination thereof of the mouse immunoglobulin heavy chain locus. In one embodiment, the one or more human immunoglobulin heavy chain variable gene segments comprises a restricted number of (e.g., one, two or three) $V_H$ gene segments, at least 27 $D_H$ gene segments, at least six $J_H$ gene segments or a combination thereof of a human immunoglobulin heavy chain locus. In a specific embodiment, the restricted number of human $V_H$ gene segments is one.

In one embodiment, the one or more mouse immunoglobulin κ light chain variable gene segments comprises about three megabases of the mouse immunoglobulin κ light chain locus. In one embodiment, the one or more mouse immunoglobulin κ light chain variable gene segments comprises at least 137 Vκ gene segments, at least five Jκ gene segments or a combination thereof of the mouse immunoglobulin κ light chain locus. In one embodiment, the one or more human immunoglobulin κ light chain variable gene segments comprises about one-half megabase of a human immunoglobulin κ light chain locus. In a specific embodiment, the one or more human immunoglobulin κ light chain variable gene segments comprises the proximal repeat (with respect to the immunoglobulin κ constant region) of a human immunoglobulin κ light chain locus. In one embodiment, the one or more human immunoglobulin κ light chain variable gene segments comprises at least 40Vκ gene segments, at least five Jκ gene segments or a combination thereof of a human immunoglobulin κ light chain locus.

In one embodiment, the nucleotide sequence is place between two human immunoglobulin gene segments. In a specific embodiment, the two human immunoglobulin gene segments are heavy chain gene segments. In one embodiment, the nucleotide sequence is placed between a human $V_H$1-69 gene segment and a human $D_H$1-1 gene segment. In one embodiment, the nucleotide sequence is placed between a human $V_H$12 gene segment and a human $D_H$1-1 gene segment. In one embodiment, the mouse so modified comprises a replacement of mouse immunoglobulin heavy chain variable gene segments with a single human $V_H$ gene segments, 27 human $D_H$ gene segments and six human $J_H$ gene segments, and a replacement of mouse immunoglobulin κ light chain variable gene segments with at least 40 human Vκ gene segments and five human Jκ gene segments.

In one aspect, a functional mouse ADAM6 locus (or ortholog or homolog or functional fragment thereof) is present in the midst of mouse gene segments that are present at the endogenous mouse heavy chain variable region locus, said locus incapable of rearranging to encode a functional heavy chain containing an endogenous heavy chain constant region. In one embodiment, the endogenous mouse heavy chain locus comprises at least one and up to 89 $V_H$ gene segments, at least one and up to 13 $D_H$ gene segments, at least one and up to four $J_H$ gene segments and a combination thereof. In various embodiments, a functional mouse ADAM6 locus (or ortholog or homolog or functional fragment thereof) encodes one or more ADAM6 proteins that are functional in the mouse, wherein the one or more ADAM6 proteins comprise SEQ ID NO: 1, SEQ ID NO: 2 and/or a combination thereof.

In one aspect, a functional mouse ADAM6 locus (or ortholog or homolog or functional fragment thereof) is present in the midst of human gene segments that replace endogenous mouse gene segments. In one embodiment, at least 89 mouse $V_H$ gene segments are removed and replaced with one, two or three human $V_H$ gene segments, and the mouse ADAM6 locus is present immediately adjacent to the 3' end of the human $V_H$ gene segments, or between two human $V_H$ gene segments. In one embodiment, at least 89 mouse $V_H$ gene segments are removed and replaced with a single human $V_H$ gene segment, and the mouse ADAM6 locus is present immediately adjacent to the 3' end of the human $V_H$ gene segment. In a specific embodiment, the mouse ADAM6 locus is present 3' of the $V_H$ gene segment within about 20 kilo bases (kb) to about 40 kilo bases (kb) of the 3' terminus of the inserted human $V_H$ gene segment. In a specific embodiment, the mouse ADAM6 locus is present 3' of the $V_H$ gene segment within about 29 kb to about 31 kb of the 3' terminus of the inserted human $V_H$ gene segment. In a specific embodiment, the mouse ADAM6 locus is present within about 30 kb of the 3' terminus of the inserted human $V_H$ gene segment. In a specific embodiment, the mouse ADAM6 locus is present within about 30,184 bp of the 3' terminus of the inserted human $V_H$ gene segment. In a specific embodiment, the replacement includes human gene segments $V_H$1-69 and $D_H$1-1, and the mouse ADAM6 locus is present downstream of the $V_H$1-69 gene segment and upstream of the $D_H$1-1 gene segment. In a specific embodiment, the mouse ADAM6 locus is present between a human $V_H$1-69 gene segment and a human $D_H$1-1 gene segment, wherein the 5' end of the mouse ADAM6 locus is about 258 bp from the 3' terminus of the human $V_H$1-69 gene segment and the 3' end of the ADAM6 locus is about 3,263 bp 5' of the human $D_H$1-1 gene segment. In a specific embodiment, the mouse ADAM6 locus comprises SEQ ID NO:3 or a fragment thereof that confers ADAM6 function within cells of the mouse. In a specific embodiment, the mouse ADAM6 locus comprises SEQ ID NO: 73 or a fragment thereof that confers ADAM6 function within cells of the mouse. In a specific embodiment, the mouse ADAM6 locus comprises SEQ ID NO: 77 or a fragment thereof that confers ADAM6 function within cells of the mouse. In a specific embodiment, the arrangement of human gene segments is then the following (from upstream to downstream with respect to direction of transcription of the human gene segments): human $V_H$1-69-mouse ADAM6 locus-human $D_H$1-1. In one embodiment, the orientation of one or more of mouse ADAM6a and mouse ADAM6b of the mouse ADAM6 locus is opposite with respect to direction of transcription as compared with the orientation of the human gene segments. Alternatively, the mouse ADAM6 locus is present 5' to, or upstream of, the single human $V_H$ gene segment.

In a specific embodiment, the replacement includes human gene segments $V_H$1-2 and $D_H$1-1, and the mouse ADAM6 locus is present upstream of the $V_H$1-2 gene segment and upstream of the $D_H$1-1 gene segment. In a specific embodiment, the mouse ADAM6 locus is present upstream, or 5', of a human $V_H$1-2 gene segment and a human $D_H$1-1 gene segment, wherein the 5' end of the mouse ADAM6 locus is about 32,833 bp from the 5' terminus of the human $V_H$1-2 gene segment and the 3' end of the ADAM6 locus is about 18,078 bp from the 5' terminus of the human $V_H$1-2 gene segment. In a specific embodiment, the mouse ADAM6 locus comprises SEQ ID NO:3 or a fragment thereof that confers ADAM6 function within cells of the mouse. In a specific embodiment, the mouse ADAM6 locus comprises SEQ ID NO: 73 or a fragment thereof that confers ADAM6 function within cells of the mouse. In a specific embodiment, the mouse ADAM6 locus comprises SEQ ID NO: 77 or a fragment thereof that confers ADAM6 function within cells of the mouse. In a specific embodiment, the arrangement of human gene segments is then the following (from upstream to downstream with respect to direction of transcription of the human gene segments): mouse ADAM6 locus-human $V_H$1-2-human $D_H$1-1. In one embodiment, the orientation of one or more of mouse ADAM6a and mouse ADAM6b of the mouse ADAM6 locus is opposite with respect to direction of transcription as compared with the orientation of the human gene segments. Alternatively, the mouse ADAM6 locus is present 3' to, or downstream of, the single human $V_H$ gene segment.

Similarly, a mouse modified with one or more human $V_L$ gene segments (e.g., Vκ or Vλ segments) replacing all or substantially all endogenous mouse $V_H$ gene segments can be modified so as to either maintain the endogenous mouse ADAM6 locus, as described above, e.g., by employing a targeting vector having a downstream homology arm that includes a mouse ADAM6 locus or functional fragment thereof, or to replace a damaged mouse ADAM6 locus with an ectopic sequence positioned between two human $V_L$ gene segments or between the human $V_L$ gene segments and a $D_H$ gene segment (whether human or mouse, e.g., Vλ+m/hD$_H$), or a J gene segment (whether human or mouse, e.g., Vκ+J$_H$). In one embodiment, the replacement includes two or more human V$_L$ gene segments, and the mouse ADAM6 locus or functional fragment thereof is present between the two 3'-most V$_L$ gene segments. In a specific embodiment, the arrangement of human V$_L$ gene segments is then the following (from upstream to downstream with respect to direction of transcription of the human gene segments): human V$_L$3'-1-mouse ADAM6 locus-human V$_L$3'. In one embodiment, the orientation of one or more of mouse ADAM6a and mouse ADAM6b of the mouse ADAM6 locus is opposite with respect to direction of transcription as compared with the orientation of the human VL gene segments. Alternatively, the mouse ADAM6 locus is present in the intergenic region between the 3'-most human V$_1$ gene segment and the 5'-most D$_H$ gene segment. This can be the case whether the 5'-most D$_H$ segment is mouse or human.

In one aspect, a mouse is provided with a replacement of one or more endogenous mouse V$_H$ gene segments, and that comprises at least one endogenous mouse D$_H$ gene segment. In such a mouse, the modification of the endogenous mouse V$_H$ gene segments can comprise a modification of one or more of the 3'-most V$_H$ gene segments, but not the 5'-most D$_H$ gene segment, where care is taken so that the modification of the one or more 3'-most V$_H$ gene segments does not disrupt or render the endogenous mouse ADAM6 locus nonfunctional. For example, in one embodiment the mouse comprises a replacement of all or substantially all endogenous mouse V$_H$ gene segments with a single human V$_H$ gene segment, and the mouse comprises one or more endogenous D$_H$ gene segments and a functional endogenous mouse ADAM6 locus.

In another embodiment, the mouse comprises the modification of endogenous mouse 3'-most V$_H$ gene segments, and a modification of one or more endogenous mouse D$_H$ gene segments, and the modification is carried out so as to maintain the integrity of the endogenous mouse ADAM6 locus to the extent that the endogenous ADAM6 locus remains functional. In one example, such a modification is done in two steps: (1) replacing the 3'-most endogenous mouse V$_H$ gene segments with a single human V$_H$ gene segments employing a targeting vector with an upstream homology arm and a downstream homology arm wherein the downstream homology arm includes all or a portion of a functional mouse ADAM6 locus; (2) then replacing and endogenous mouse D$_H$ gene segment with a targeting vector having an upstream homology arm that includes a all or a functional portion of a mouse ADAM6 locus.

In various aspects, employing mice that contain an ectopic sequence that encodes a mouse ADAM6 protein or an ortholog or homolog or functional homolog thereof are useful where modifications disrupt the function of endogenous mouse ADAM6. The probability of disrupting endogenous mouse ADAM6 function is high when making modifications to mouse immunoglobulin loci, in particular when modifying mouse immunoglobulin heavy chain variable regions and surrounding sequences. Therefore, such mice provide particular benefit when making mice with immunoglobulin heavy chain loci that are deleted in whole or in part, are humanized in whole or in part, or are replaced (e.g., with Vκ or Vλ sequences) in whole or in part. Methods for making the genetic modifications described for the mice described below are known to those skilled in the art.

Mice containing an ectopic sequence encoding a mouse ADAM6 protein, or a substantially identical or similar protein that confers the fertility benefits of a mouse ADAM6 protein, are particularly useful in conjunction with modifications to a mouse immunoglobulin heavy chain variable gene locus that disrupt or delete the endogenous mouse ADAM6 sequence. Although primarily described in connection with mice that express antibodies with human variable regions and mouse constant regions, such mice are useful in connection with any genetic modifications that disrupt endogenous mouse ADAM6 genes. Persons of skill will recognize that this encompasses a wide variety of genetically modified mice that contain modifications of mouse immunoglobulin heavy chain variable gene loci. These include, for example, mice with a deletion or a replacement of all or a portion of mouse immunoglobulin heavy chain gene segments, regardless of other modifications. Non-limiting examples are described below.

In some aspects, genetically modified mice are provided that comprise an ectopic mouse, rodent, or other ADAM6 gene (or ortholog or homolog or fragment) functional in a mouse, and one or more human immunoglobulin variable and/or constant region gene segments. In various embodiments, other ADAM6 gene orthologs or homologs or fragments functional in a mouse may include sequences from bovine, canine, primate, rabbit or other non-human sequences.

In one aspect, a mouse is provided that comprises an ectopic ADAM6 sequence that encodes a functional ADAM6 protein, a replacement of all or substantially all mouse V$_H$ gene segments with a single human V$_H$ gene segment; a replacement of all or substantially all mouse D$_H$ gene segments with one or more human D$_H$ gene segments; and a replacement of all or substantially all mouse J$_H$ gene segments with one or more human J$_H$ gene segments.

In one embodiment, the mouse further comprises a replacement of a mouse C$_H$1 nucleotide sequence with a human C$_H$1 nucleotide sequence. In one embodiment, the mouse further comprises a replacement of a mouse hinge nucleotide sequence with a human hinge nucleotide sequence. In one embodiment, the mouse further comprises a replacement of an immunoglobulin light chain variable locus (V$_L$ and J$_L$) with a human immunoglobulin light chain variable locus. In one embodiment, the mouse further comprises a replacement of a mouse immunoglobulin light chain constant region nucleotide sequence with a human immunoglobulin light chain constant region nucleotide sequence. In a specific embodiment, the V$_L$, J$_L$, and C$_L$ are immunoglobulin κ light chain sequences. In a specific embodiment, the mouse comprises a mouse C$_H$2 and a mouse C$_H$3 immunoglobulin constant region sequence fused with a human hinge and a human C$_H$1 sequence, such that the mouse immunoglobulin loci rearrange to form a gene that encodes a binding protein comprising (a) a heavy chain that has a human variable region, a human C$_H$1 region, a human hinge region, and a mouse C$_H$2 and a mouse C$_H$3 region; and (b) a gene that encodes an immunoglobulin light chain that comprises a human variable domain and a human constant region.

In one aspect, a mouse is provided that comprises an ectopic ADAM6 sequence that encodes a functional ADAM6 protein, a replacement of all or substantially all mouse V$_H$ gene segments with one or more human V$_L$ gene segments, and optionally a replacement of all or substantially all D$_H$ gene segments and/or J$_H$ gene segments with one or more human D$_H$ gene segments and/or human J$_H$ gene segments, or optionally a replacement of all or substantially all D$_H$ gene segments and J$_H$ gene segments with one or more human J$_L$ gene segments.

In one embodiment, the mouse comprises a replacement of all or substantially all mouse $V_H$, $D_H$, and $J_H$ gene segments with one or more $V_L$, one or more $D_H$, and one or more J gene segments (e.g., Jκ or Jλ), wherein the gene segments are operably linked to an endogenous mouse hinge region, wherein the mouse forms a rearranged immunoglobulin chain gene that contains, from 5' to 3' in the direction of transcription, human $V_L$-human or mouse $D_H$-human or mouse J-mouse hinge-mouse $C_H2$-mouse $C_H3$. In one embodiment, the J region is a human Jκ region. In one embodiment, the J region is a human $J_H$ region. In one embodiment, the J region is a human Jλ region. In one embodiment, the human $V_L$ region is selected from a human Vλ region and a human Vκ region.

In specific embodiments, the mouse expresses a single variable domain antibody having a mouse or human constant region and a variable region derived from a human Vκ, a human $D_H$ and a human Jκ; a human Vκ, a human $D_H$, and a human $J_H$; a human Vλ, a human $D_H$, and a human Jλ; a human Vλ, a human $D_H$, and a human $J_H$; a human Vκ, a human $D_H$, and a human Jλ; a human Vλ, a human $D_H$, and a human Jκ. In specific embodiment, recombination recognition sequences are modified so as to allow for productive rearrangements to occur between recited V, D, and J gene segments or between recited V and J gene segments.

In one aspect, a mouse is provided that comprises an ectopic ADAM6 sequence that encodes a functional ADAM6 protein (or ortholog or homolog or functional fragment thereof), a replacement of all or substantially all mouse $V_H$ gene segments with one or more human $V_L$ gene segments, a replacement of all or substantially all mouse $D_H$ gene segment and $J_H$ gene segments with human $J_L$ gene segments; wherein the mouse lacks a $C_H1$ and/or hinge region.

In one embodiment, the mouse lacks a sequence encoding a $C_H1$ domain. In one embodiment, the mouse lacks a sequence encoding a hinge region. In one embodiment, the mouse lacks a sequence encoding a $C_H1$ domain and a hinge region.

In a specific embodiment, the mouse expresses a binding protein that comprises a human immunoglobulin light chain variable domain (λ or κ) fused to a mouse $C_H2$ domain that is attached to a mouse $C_H3$ domain.

In one aspect, a mouse is provided that comprises an ectopic ADAM6 sequence that encodes a functional: ADAM6 protein (or ortholog or homolog or functional fragment thereof), a replacement of all or substantially all mouse $V_H$ gene segments with one or more human $V_L$ gene segments, a replacement of all or substantially all mouse $D_H$ and $J_H$ gene segments with human $J_L$ gene segments.

In one embodiment, the mouse comprises a deletion of an immunoglobulin heavy chain constant region gene sequence encoding a $C_H1$ region, a hinge region, a $C_H1$ and a hinge region, or a $C_H1$ region and a hinge region and a $C_H2$ region.

In one embodiment, the mouse makes a single variable domain binding protein comprising a homodimer selected from the following: (a) human $V_L$-mouse $C_H1$-mouse $C_H2$-mouse $C_H3$; (b) human $V_L$-mouse hinge-mouse $C_H2$-mouse $C_H3$; (c) human $V_L$-mouse $C_H2$-mouse $C_H3$.

In one aspect, a mouse is provided with a disabled endogenous heavy chain immunoglobulin locus, comprising a disabled or deleted endogenous mouse ADAM6 locus, wherein the mouse comprises a nucleic acid sequence that expresses a human or mouse or human/mouse or other chimeric antibody. In one embodiment, the nucleic acid sequence is present on a transgene integrated that is randomly integrated into the mouse genome. In one embodiment, the nucleic acid sequence is on an episome (e.g., a chromosome) not found in a wild-type mouse.

In one embodiment, the mouse further comprises a disabled endogenous immunoglobulin light chain locus. In a specific embodiment, the endogenous immunoglobulin light chain locus is selected from a kappa (κ) and a lambda (λ) light chain locus. In a specific embodiment, the mouse comprises a disabled endogenous κ light chain locus and a disabled λ light chain locus, wherein the mouse expresses an antibody that comprises a human immunoglobulin heavy chain variable domain and a human immunoglobulin light chain domain. In one embodiment, the human immunoglobulin light chain domain is selected from a human κ light chain domain and a human λ light chain domain.

In one aspect, a genetically modified animal is provided that expresses a chimeric antibody and expresses an ADAM6 protein or ortholog or homolog thereof that is functional in the genetically modified animal.

In one embodiment, the genetically modified animal is selected from a mouse and a rat. In one embodiment, the genetically modified animal is a mouse, and the ADAM6 protein or ortholog or homolog thereof is from a mouse strain that is a different strain than the genetically modified animal. In one embodiment, the genetically modified animal is a rodent of family Cricetidae (e.g., a hamster, a New World rat or mouse, a vole), and the ADAM6 protein ortholog or homolog is from a rodent of family Muridae (e.g., true mouse or rat, gerbil, spiny mouse, crested rat). In one embodiment, the genetically modified animal is a rodent of the family Muridae, and the ADAM6 protein ortholog or homolog is from a rodent of family Cricetidae.

In one embodiment, the chimeric antibody comprises a human variable domain and a constant region sequence of a rodent. In one embodiment, the rodent is selected from a rodent of the family Cricetidae and a rodent of family Muridae. In a specific embodiment, the rodent of the family Cricetidae and of the family Muridae is a mouse. In a specific embodiment, the rodent of the family Cricetidae and of the family Muridae is a rat. In one embodiment, the chimeric antibody comprises a human variable domain and a constant domain from an animal selected from a mouse or rat; in a specific embodiment, the mouse or rat is selected from the family Cricetidae and the family Muridae. In one embodiment, the chimeric antibody comprises a human heavy chain variable domain, a human light chain variable domain and a constant region sequence derived from a rodent selected from mouse and rat, wherein the human heavy chain variable domain and the human light chain are cognate. In a specific embodiment, cognate includes that the human heavy chain and the human light chain variable domains are from a single B cell that expresses the human light chain variable domain and the human heavy chain variable domain together and present the variable domains together on the surface of an individual B cell.

In one embodiment, the chimeric antibody is expressed from an immunoglobulin locus. In one embodiment, the heavy chain variable domain of the chimeric antibody is expressed from a rearranged endogenous immunoglobulin heavy chain locus. In one embodiment, the light chain variable domain of the chimeric antibody is expressed from a rearranged endogenous immunoglobulin light chain locus. In one embodiment, the heavy chain variable domain of the chimeric antibody and/or the light chain variable domain of the chimeric antibody is expressed from a rearranged transgene (e.g., a rearranged nucleic acid sequence derived from an unrearranged nucleic acid sequence integrated into the animal's genome at a locus other than an endogenous immunoglobulin locus). In one embodiment, the tight chain variable domain of the chimeric antibody is expressed from a rearranged transgene (e.g., a rearranged nucleic acid sequence derived from an unrearranged nucleic acid sequence integrated into the animal's genome at a locus other than an endogenous immunoglobulin locus).

In a specific embodiment, the transgene is expressed from a transcriptionally active locus, e.g., a ROSA26 locus, e.g., a murine (e.g., mouse) ROSA26 locus.

In one aspect, a non-human animal is provided, comprising a humanized immunoglobulin heavy chain locus, wherein the humanized immunoglobulin heavy chain locus comprises a non-human ADAM6 sequence or ortholog or homolog thereof.

In one embodiment, the non-human ADAM6 ortholog or homolog is a sequence that is orthologous and/or homologous to a mouse ADAM6 sequence, wherein the ortholog or homolog is functional in the non-human animal.

In one embodiment, the non-human animal is a rodent selected from a mouse, a rat, and a hamster.

In one embodiment, the non-human animal is selected from a mouse, a rat, and a hamster and the ADAM6 ortholog or homolog is from a non-human animal selected from a mouse, a rat, and a hamster. In a specific embodiment, the non-human animal is a mouse and the ADAM6 ortholog or homolog is from an animal that is selected from a different mouse species, a rat, and a hamster. In specific embodiment, the non-human animal is a rat, and the ADAM6 ortholog or homolog is from a rodent that is selected from a different rat species, a mouse, and a hamster. In a specific embodiment, the non-human animal is a hamster, and the ADAM6 ortholog or homolog is form a rodent that is selected from a different hamster species, a mouse, and a rat.

In a specific embodiment, the non-human animal is from the suborder Myomorpha, and the ADAM6 sequence is from an animal selected from a rodent of superfamily Dipodoidea and a rodent of the superfamily Muroidea. In a specific embodiment, the rodent is a mouse of superfamily Muroidea, and the ADAM6 ortholog or homolog is from a mouse or a rat or a hamster of superfamily Muroidea.

In one embodiment, the humanized heavy chain locus comprises a single human $V_H$ gene segment, one or more human. $D_H$ gene segments and one or more human $J_H$ gene segments. In a specific embodiment, the human $V_H$ gene segment, one or more human $D_H$ gene segments and one or more human $J_H$ gene segments are operably linked to one or more human, chimeric and/or rodent (e.g., mouse or rat) constant region genes. In one embodiment, the constant region genes are mouse. In one embodiment, the constant region genes are rat. In one embodiment, the constant region genes are hamster. In one embodiment, the constant region genes comprise a sequence selected from a hinge, a $C_H2$, a $C_H3$, and a combination thereof. In specific embodiment, the constant region genes comprise a hinge, a $C_H2$, and a $C_H3$ sequence.

In one embodiment, the non-human ADAM6 sequence is contiguous with a human immunoglobulin heavy chain sequence. In one embodiment, the non-human ADAM6 sequence is positioned within a human immunoglobulin heavy chain sequence. In a specific embodiment, the human immunoglobulin heavy chain sequence comprises a V, D and/or J gene segment.

In one embodiment, the non-human ADAM6 sequence is juxtaposed with a V gene segment. In one embodiment, the non-human ADAM6 sequence is positioned between two V gene segments. In one embodiment, the non-human ADAM6 sequence is juxtaposed between a V and a D gene segment. In one embodiment, the mouse ADAM6 sequence is positioned between a V and a J gene segment. In one embodiment, the mouse ADAM6 sequence is juxtaposed between a D and a J gene segment.

In one aspect, a genetically modified non-human animal is provided, comprising a B cell that expresses a human $V_H$ domain cognate with a human $V_L$ domain from an immunoglobulin locus, wherein the non-human animal expresses a non-immunoglobulin non-human protein from the immunoglobulin locus. In one embodiment, the non-immunoglobulin non-human protein is an ADAM protein. In a specific embodiment, the ADAM protein is an ADAM6 protein or homolog or ortholog or functional fragment thereof.

In one embodiment the non-human animal is a rodent (e.g., mouse or rat). In one embodiment, the rodent is of family Muridae. In one embodiment, the rodent is of subfamily Murinae. In a specific embodiment, the rodent of subfamily Murinae is selected from a mouse and a rat.

In one embodiment, the non-immunoglobulin non-human protein is a rodent protein. In one embodiment, the rodent is of family Muridae. In one embodiment, the rodent is of subfamily Murinae. In a specific embodiment, the rodent is selected from a mouse, a rat, and a hamster.

In one embodiment, the human $V_H$ and $V_L$ domains are attached directly or through a linker to an immunoglobulin constant domain sequence. In a specific embodiment, the constant domain sequence comprises a sequence selected from a hinge, a $C_H2$ a $C_H3$, and a combination thereof. In a specific embodiment, the human. $V_L$ domain is selected from a Vκ or a Vλ domain.

In one aspect, a genetically modified non-human animal is provided, comprising in its germline a human immunoglobulin sequence, wherein the sperm of a male non-human animal is characterized by an in vivo migration defect. In one embodiment, the in vivo migration defect comprises an inability of the sperm of the male non-human animal to migrate from a uterus through an oviduct of a female non-human animal of the same species. In one embodiment, the non-human animal lacks a nucleotide sequence that encodes and ADAM6 protein or functional fragment thereof. In a specific embodiment, the ADAM6 protein or functional fragment thereof includes an ADAM6a and/or an ADAM6b protein or functional fragments thereof. In one embodiment, the non-human animal is a rodent. In a specific embodiment, the rodent is selected from a mouse, a rat, and a hamster.

In one aspect, a non-human animal is provided, comprising a human immunoglobulin sequence contiguous with a non-human sequence that encodes an ADAM6 protein or ortholog or homolog or functional fragment thereof. In one embodiment, the non-human animal is a rodent. In a specific embodiment, the rodent is selected from a mouse, a rat, and a hamster.

In one embodiment, the human immunoglobulin sequence is an immunoglobulin heavy chain sequence. In one embodiment, the immunoglobulin sequence comprises a single $V_H$ gene segments. In one embodiment, the human immunoglobulin sequence comprises one or more $D_H$ gene segments. In one embodiment, the human immunoglobulin sequence comprises one or more $J_H$ gene segments. In one embodiment, the human immunoglobulin sequence comprises a single $V_H$ gene segments, one or more $D_H$ gene segments and one or more $J_H$ gene segments.

In one embodiment, the immunoglobulin sequence comprises a single $V_H$ gene segment that is associated with polymorphism in natural human repertoires. In a specific embodiment, the single $V_H$ gene segment is selected from human $V_H1$-2, $V_H1$-69, $V_H2$-26, $V_H2$-70, or $V_H3$-23. In another specific embodiment the single $V_H$ gene segment is $V_H1$-2. In another specific embodiment, the single $V_H$ gene segment is $V_H1$-69.

In one embodiment, the immunoglobulin sequence comprises a single $V_H$ gene segment that is associated with multiple copy number in natural human repertoires. In a specific embodiment, the single $V_H$ gene segment is selected from human $V_H1$-2, $V_H1$-69, $V_H2$-26, $V_H2$-70, or $V_H3$-23. In another specific embodiment the single $V_H$ gene segment is $V_H1$-2. In another specific embodiment, the single $V_H$ gene segment is $V_H1$-69.

In various embodiments, the $V_H$ gene segment is selected from $V_H6$-1, $V_H1$-2, $V_H1$-3, $V_H2$-5, $V_H3$-7, $V_H1$-8, $V_H3$-9, $V_H3$-11, $V_H3$-13, $V_H3$-15, $V_H3$-16, $V_H1$-18, $V_H3$-20, $V_H3$-21, $V_H3$-23, $V_H1$-24, $V_H2$-26, $V_H4$-28, $V_H3$-30, $V_H4$-31, $V_H3$-33, $V_H4$-34, $V_H3$-35, $V_H3$-38, $V_H4$-39, $V_H3$-43, $V_H1$-45, $V_H1$-46, $V_H3$-48, $V_H3$-49, $V_H5$-51, $V_H3$-53, $V_H1$-58, $V_H4$-59, $V_H4$-61, $V_H3$-64, $V_H3$-66, $V_H1$-69, $V_H2$-70, $V_H3$-72, $V_H3$-73 and $V_H3$-74.

In various embodiments, the $V_H$ gene segment is selected from Table 1 and is represented in natural human repertoires by five or more alleles. In a specific embodiment the $V_H$ gene is selected from $V_H1$-2, $V_H1$-69, $V_H2$-5, $V_H2$-70, $V_H3$-15, $V_H3$-23, $V_H3$-30, $V_H3$-33, $V_H3$-49, $V_H3$-64, $V_H4$-4, $V_H4$-28, $V_H4$-30-2, $V_H4$-30-4, $V_H4$-31, $V_H4$-34, $V_H4$-39, $V_H4$-59, $V_H4$-61, $V_H5$-51 and $V_H7$-4-1.

In one embodiment, the non-human animal is a mouse, and the mouse comprises a replacement of endogenous mouse $V_H$ gene segments with a single human $V_H$ gene segments, wherein the human $V_H$ gene segment is operably linked to a mouse $C_H$ region gene, such that the mouse rearranges the human $V_H$ gene segment and expresses a reverse chimeric immunoglobulin heavy chain that comprises a human $V_H$ domain and a mouse $C_H$. In one embodiment, 90-100% of unrearranged mouse $V_H$ gene segments are replaced with one unrearranged human $V_H$ gene segment. In a specific embodiment, all or substantially all of the endogenous mouse $V_H$ gene segments are replaced with one unrearranged human $V_H$ gene segment. In one embodiment, the replacement is with an unrearranged human $V_H1$-69 gene segment. In one embodiment, the replacement is with an unrearranged human $V_H1$-2 gene segment. In one embodiment, the replacement is with an unrearranged human $V_H2$-26 gene segment. In one embodiment, the replacement is with an unrearranged human $V_H2$-70 gene segment. In one embodiment, the replacement is with an unrearranged human $V_H3$-23 gene segment.

In one embodiment, the mouse comprises a replacement of all mouse $D_H$ and $J_H$ segments with at least one unrearranged human $D_H$ segment and at least one unrearranged human $J_H$ segment. In one embodiment, the at least one unrearranged human $D_H$ segment is selected from 1-1, 1-7, 1-26, 2-8, 2-15, 3-3, 3-10, 3-16, 3-22, 5-5, 5-12, 6-6, 6-13, 7-27, and a combination thereof. In one embodiment, the at least one unrearranged human $J_H$ segment is selected from 1, 2, 3, 4, 5, 6, and a combination thereof.

In various embodiments, the human immunoglobulin sequence is in operable linkage with a constant region in the germline of the non-human animal (e.g., the rodent, e.g., the mouse, rat, or hamster). In one embodiment, the constant region is a human, chimeric human/mouse or chimeric human/rat or chimeric human/hamster, a mouse, a rat, or a hamster constant region. In one embodiment, the constant region is a rodent (e.g., mouse or rat or hamster) constant region. In a specific embodiment, the rodent is a mouse or rat. In various embodiments, the constant region comprises at least a $C_H2$ domain and a $C_H3$ domain.

In one embodiment, the human immunoglobulin heavy chain sequence is located at an immunoglobulin heavy chain locus in the germline of the non-human animal (e.g., the rodent, e.g., the mouse or rat or hamster). In one embodiment, the human immunoglobulin heavy chain sequence is located at a non-immunoglobulin heavy chain locus in the germline of the non-human animal, wherein the non-heavy chain locus is a transcriptionally active locus. In a specific embodiment, the non-heavy chain locus is a ROSA26 locus.

In various aspects, the non-human animal further comprises a human immunoglobulin light chain sequence (e.g., one or more unrearranged light chain V and J sequences, or one or more rearranged VJ sequences) in the germline of the non-human animal. In a specific embodiment, the immunoglobulin light chain sequence is an immunoglobulin κ light chain sequence. In one embodiment, the human immunoglobulin light chain sequence comprises one or more $V_L$ gene segments. In one embodiment, the human immunoglobulin light chain sequence comprises one or more $J_L$ gene segments. In one embodiment, the human immunoglobulin light chain sequence comprises one or more $V_L$ gene segments and one or more $J_L$ gene segments. In a specific embodiment, the human immunoglobulin light chain sequence comprises at least 16 Vκ gene segments and five Jκ gene segments. In a specific embodiment, the human immunoglobulin light chain sequence comprises at least 30 Vκ gene segments and five Jκ gene segments. In a specific embodiment, the human immunoglobulin light chain sequence comprises at least 40 Vκ gene segments and five Jκ gene segments. In various embodiments, the human immunoglobulin light chain sequence is in operable linkage with a constant region in the germline of the non-human animal (e.g., rodent, e.g., mouse or rat or hamster). In one embodiment, the constant region is a human, chimeric human/rodent, mouse, rat, or hamster constant region. In a specific embodiment, the constant region is a mouse or rat constant region. In a specific embodiment, the constant region is a mouse κ constant (mCκ) region or a rat κ constant (rCκ) region.

In one embodiment, the non-human animal is a mouse and the mouse comprises a replacement of all or substantially all Vκ and Jκ gene segments with at least six human Vκ gene segments and at least one Jκ gene segment. In one embodiment, all or substantially all Vκ and Jκ gene segments are replaced with at least 16 human Vκ gene segments (human Vκ) and at least one Jκ gene segment. In one embodiment, all or substantially all Vκ and Jκ gene segments are replaced with at least 30 human Vκ gene segments and at least one Jκ gene segment. In one embodiment, all or substantially all Vκ and Jκ gene segments are replaced with at least 40 human Vκ gene segments and at least one Jκ gene segment. In one embodiment, the at least one Jκ gene segment comprises two, three, four, or five human Jκ gene segments.

In one embodiment, the human Vκ gene segments comprise Vκ4-1, Vκ5-2, Vκ7-3, Vκ2-4, Vκ1-5, and Vκ1-6. In one embodiment, the Vκ gene segments comprise Vκ3-7, Vκ1-8, Vκ1-9, Vκ2-10, Vκ3-11, Vκ1-12, Vκ1-13, Vκ2-14, Vκ3-15 and Vκ1-16. In one embodiment, the human Vκ gene segments comprise Vκ1-17, Vκ2-18, Vκ2-19, Vκ3-20, Vκ6-21, Vκ1-22, Vκ1-23, Vκ2-24, Vκ3-25, Vκ2-26, Vκ1-27, Vκ2-28, Vκ2-29, and Vκ2-30. In one embodiment, the human Vκ gene segments comprise Vκ3-31, Vκ1-32, Vκ1-33, Vκ3-34, Vκ1-35, Vκ2-36, Vκ1-37, Vκ2-38, Vκ1-39, and Vκ2-40.

In a specific embodiment, the Vκ gene segments comprise contiguous human immunoglobulin κ gene segments spanning the human immunoglobulin κ light chain locus from Vκ4-1 through Vκ2-40, and the Jκ gene segments comprise contiguous gene segments spanning the human immunoglobulin κ light chain locus from Jκ1 through Jκ5.

In one embodiment, the human immunoglobulin light chain sequence is located at an immunoglobulin light chain locus in the germline of the non-human animal. In a specific embodiment, the immunoglobulin light chain locus in the germline of the non-human animal is an immunoglobulin κ light chain locus. In one embodiment, the human immunoglobulin light chain sequence is located at a non-immunoglobulin light chain locus in the germline of the non-human animal that is transcriptionally active. In a specific embodiment, the non-immunoglobulin locus is a ROSA26 locus.

In one aspect, a method of making a human antibody is provided, wherein the human antibody comprises variable domains derived from one or more variable region nucleic acid sequences encoded in a cell of a non-human animal as described herein.

In one aspect, a method of making an anti-idiotype antibody is provided, wherein the anti-idiotype antibody comprises variable domains derived from one or more variable region nucleic acid sequences encoded in a cell of a non-human animal as described herein, the method comprising exposing a non-human animal as described herein to an antibody comprising human variable domains. In one embodiment, the anti-idiotype antibody is specific for or is capable of binding a human heavy chain variable domain. In one embodiment, the antibody is specific for or is capable of binding a human light chain variable domain.

In a specific embodiment, the anti-idiotype antibody is specific for or is capable of binding a human heavy chain variable domain, wherein the human heavy chain variable domain comprises a rearranged human $V_H$ gene segment selected from $V_H6$-1, $V_H1$-2, $V_H1$-3, $V_H2$-5, $V_H3$-7, $V_H1$-8, $V_H3$-9, $V_H3$-11, $V_H3$-13, $V_H3$-15, $V_H3$-16, $V_H1$-18, $V_H3$-20, $V_H3$-21, $V_H3$-23, $V_H1$-24, $V_H2$-26, $V_H4$-28, $V_H3$-30, $V_H4$-31, $V_H3$-33, $V_H4$-34, $V_H3$-35, $V_H3$-38, $V_H4$-39, $V_H3$-43, $V_H1$-45, $V_H1$-46, $V_H3$-48, $V_H3$-49, $V_H5$-51, $V_H3$-53, $V_H1$-58, $V_H4$-59, $V_H4$-61, $V_H3$-64, $V_H3$-66, $V_H1$-69, $V_H2$-70, $V_H3$-72, $V_H3$-73 and $V_H3$-74.

In a specific embodiment, the anti-idiotype antibody is specific for or is capable of binding a human heavy chain variable domain, wherein the human heavy chain variable domain comprises a rearranged human $V_H$ gene segment selected from $V_H1$-2, $V_H1$-69, $V_H2$-5, $V_H2$-70, $V_H3$-15, $V_H3$-23, $V_H3$-30, $V_H3$-33, $V_H3$-49, $V_H3$-64, $V_H4$-4, $V_H4$-28, $V_H4$-30-2, $V_H4$-30-4, $V_H4$-31, $V_H4$-34, $V_H4$-39, $V_H4$-59, $V_H4$-61, $V_H5$-51 and $V_H7$-4-1

In a specific embodiment, the anti-idiotype antibody is specific for or is capable of binding a human light chain variable domain, wherein the human light chain variable domain comprises a rearranged human Vκ gene segment selected from Vκ4-1, Vκ5-2, Vκ7-3, Vκ2-4, Vκ1-5, Vκ1-6, Vκ3-7, Vκ1-8, Vκ1-9, Vκ2-10, Vκ3-11, Vκ1-12, Vκ1-13, Vκ2-14, Vκ3-15, Vκ1-16, Vκ1-17, Vκ2-18, Vκ2-19, Vκ3-20, Vκ6-21, Vκ1-22, Vκ1-23, Vκ2-24, Vκ3-25, Vκ2-26, Vκ1-27, Vκ2-28, Vκ2-29, Vκ2-30, Vκ3-31, Vκ1-32, Vκ1-33, Vκ3-34, Vκ1-35, Vκ2-36, Vκ1-37, Vκ2-38, Vκ1-39, and Vκ2-40.

In a specific embodiment, the anti-idiotype antibody is specific for or is capable of binding a human light chain variable domain, wherein the human light chain variable domain comprises a rearranged human Vκ1-39 gene segment.

In a specific embodiment, the anti-idiotype antibody is specific for or is capable of binding a human light chain variable domain, wherein the human light chain variable domain comprises a rearranged human Vλ gene segment selected from Vλ3-1, Vλ4-3, Vλ2-8, Vλ3-9, Vλ3-10, Vλ2-11, Vλ3-12, Vλ2-14, Vλ3-16, Vλ2-18, Vλ3-19, Vλ3-21, Vλ3-22, Vλ2-23, Vλ3-25, Vλ3-27, Vλ3-32, Vλ2-33, Vλ2-34, Vλ1-36, Vλ1-40, Vλ7-43, Vλ1-44, Vλ5-45, Vλ7-46, Vλ1-47, Vλ9-49, Vλ1-50, Vλ1-51, Vλ5-52, Vλ10-54, Vλ11-55, Vλ6-57, Vλ4-60, Vλ8-61, and Vλ4-69.

In one embodiment, a method of making an anti-idiotype antibody is provided, wherein the anti-idiotype antibody comprises variable domains derived from one or more variable region nucleic acid sequences encoded in a cell of a non-human animal that comprises a restricted immunoglobulin heavy chain locus comprising a single human $V_H$ gene segment, 27 $D_H$ gene segments, and six $J_H$ gene segments, and wherein the anti-idiotype antibody is specific for or is capable of binding a human heavy chain variable domain comprising a rearranged human $V_H1$-69 gene segment, the method comprising exposing the non-human animal to an antibody comprising the rearranged human $V_H1$-69 gene segment and isolating the anti-idiotype antibody from the non-human animal. In a specific embodiment, the single human. $V_H$ gene segment is selected from a human $V_H1$-2 and a human $V_H1$-69 gene segment.

In one embodiment, a method of making an anti-idiotype antibody is provided, wherein the anti-idiotype antibody comprises variable domains derived from one or more variable region nucleic acid sequences encoded in a cell of a non-human animal that comprises a restricted immunoglobulin heavy chain locus comprising a single human $V_H$ gene segment, 27 $D_H$ gene segments, and six $J_H$ gene segments, and wherein the anti-idiotype antibody is specific for or is capable of binding a human light chain variable domain comprising a rearranged human Vκ1-39 gene segment, the method comprising exposing the non-human animal to an antibody comprising the human Vκ1-39 gene segment and isolating the antibody from the non-human animal. In a specific embodiment, the single human $V_H$ gene segment is selected from a human $V_H1$-2 and a human $V_H1$-69 gene segment.

In one aspect, a pharmaceutical composition is provided, comprising a polypeptide that comprises antibody or antibody fragment that is derived from one or more variable region nucleic acid sequences isolated from a non-human animal as described herein. In one embodiment, the polypeptide is an antibody. In one embodiment, the polypeptide is a heavy chain only antibody. In one embodiment, the polypeptide is a single chain variable fragment (e.g., an scFv).

In one aspect, use of a non-human animal as described herein to make an antibody is provided. In various embodiments, the antibody comprises one or more variable domains that are derived from one or more variable region nucleic acid sequences isolated from the non-human animal. In a specific embodiment, the variable region nucleic acid sequences comprise immunoglobulin heavy chain gene segments. In a specific embodiment, the variable region nucleic acid sequences comprise immunoglobulin light chain gene segments.

EXAMPLES

The following examples are provided so as to describe to those of ordinary skill in the art how to make and use methods and compositions of the invention, and are not intended to limit the scope of what the inventors regard as their invention. Unless indicated otherwise, temperature is indicated in Celsius, and pressure is at or near atmospheric.

Example 1

Construction of a Restricted Humanized IgH Locus

A uniquely engineered human heavy chain locus containing a single human $V_H$ gene segment located upstream of all the human $D_H$ and $J_H$ gene segments may be constructed by homologous recombination using Bacterial Artificial Chromosome (BAC) DNA. Exemplary human $V_H$ gene segments employed for construction of such an immunoglobulin heavy chain locus include polymorphic $V_H$ gene segments and/or $V_H$ gene segments associated with a variation in copy number, such as, for example $V_H1$-2, $V_H1$-69, $V_H2$-26, $V_H2$-70, and $V_H3$-23. VELOCIGENE® genetic engineering technology can be employed for the creation of a single $V_H$ containing heavy chain locus using several targeting constructs (see, e.g., U.S. Pat. No. 6,586,251 and Valenzuela, D. M. et al., 2003, High-throughput engineering of the mouse genome coupled with high-resolution expression analysis. *Nature Biotechnology* 21(6): 652-659).

Exemplary Strategy for Construction of a Human $V_H1$-69 Restricted IgH Locus (FIG. 1).

In the first step, a modified human BAC containing multiple distal (5') human $V_H$ gene segments, including $V_H1$-69, an upstream selection cassette (e.g., hygromycin) and a 5' mouse homology arm was targeted by homologous recombination with a second selection cassette (e.g., spectinomycin), which also contained a modified recombination signal sequence (Step 1, FIG. 1). This modified recombination signal sequence (RSS) introduced two point mutations (T to A and G to A) in the 3' RSS region of the human $V_H1$-69 gene changing the RSS nonamer to the optimal consensus sequence. Thus, Step 1 resulted in a human genomic fragment containing the human $V_H1$-69 gene segment with a modified 3' RSS, a unique AsiSI restriction site about 180 bp downstream of the RSS and a spectinomycin cassette.

Step 2 included the use of a neomycin (Neo) cassette flanked by Frt sites to delete the selection cassette (hygromycin) and additional upstream (5') human $V_H$ gene segments. This modification was targeted, by homologous recombination, 5' to the human $V_H1$-69 gene segment to leave intact about 8.2 kb of the promoter region of human $V_H1$-69 and the 5' mouse homology arm.

Step 3 included another selection cassette (spectinomycin) flanked by uniquely engineered restriction sites (e.g., PI-SceI and AsiSI) targeted by homologous recombination to a human genomic fragment containing the first three functional human $V_H$ gene segments and all the human $D_H$ and $J_H$ gene segments (FIG. 1). The human genomic fragment was previously targeted by homologous recombination with a neomycin cassette and contained 5' and 3' homology arms containing the mouse genomic sequence 5' and 3' of the endogenous heavy chain locus including the 3' intronic enhancer and the IgM gene. This modification deleted the 5' mouse genomic sequence and human $V_H$ gene segments, leaving about 3.3 kb of the $V_H$-$D_H$ intergenic region upstream of the human $D_H1$-1 gene segment, all of the human $D_H$ and $J_H$ segments, and the 3' mouse genomic fragment containing the 3' intronic enhancer and the IgM gene (FIG. 1).

Step 4 was accomplished by using the unique restriction sites (described above) to cut followed by ligation of the two modified BACs from Step 2 and Step 3, which yielded the final targeting construct. The final targeting construct for the creation of a modified heavy chain locus containing a human $V_H1$-69 gene segment, all the human $D_H$, and all the human $J_H$ gene segments in ES cells contained, from 5' to 3', a 5' homology arm containing about 20 kb of mouse genomic sequence upstream of the endogenous heavy chain locus, a 5' Frt site, a neomycin cassette, a 3' Frt site, about 8.2 kb of the human $V_H1$-69 promoter, the human $V_H1$-69 gene segment with a modified 3' RSS, 27 human $D_H$ gene segments, six human $J_H$ segments, and a 3' homology arm containing about 8 kb of mouse genomic sequence downstream of the mouse $J_H$ gene segments including the 3' intronic enhancer and IgM gene (FIG. 1).

Figure 2:
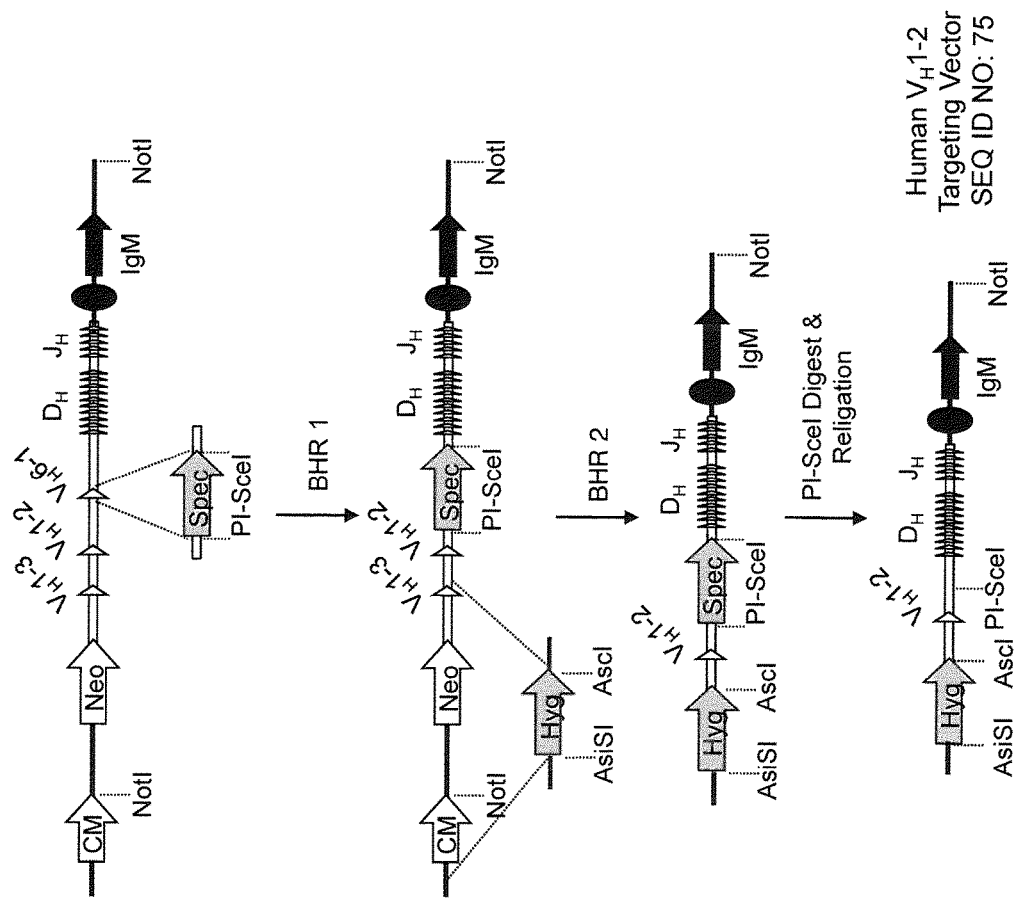
FIG. 2 shows a general illustration, not to scale, of a series of targeting and molecular engineering steps employed to make a targeting vector for construction of a modified heavy chain locus containing a single human $V_H$1-2 gene segment, twenty-seven human $D_H$ and six human $J_H$ gene segments at an endogenous immunoglobulin heavy chain locus.

Exemplary Strategy for Construction of a Human $V_H1$-2 Restricted IgH Locus (FIG. 2).

In a similar fashion, other polymorphic $V_H$ gene segments in the context of mouse heavy chain constant regions are employed to construct a series of mice having a restricted number immunoglobulin heavy chain V segments (e.g., 1, 2, 3, 4, or 5), wherein the V segments are polymorphic variants of a V gene family member. Exemplary polymorphic $V_H$ gene segments are derived from human $V_H$ gene segments including, e.g., $V_H1$-2, $V_H2$-26, $V_H2$-70 and $V_H3$-23. Such human $V_H$ gene segments are obtained, e.g., by de novo synthesis (e.g., Blue Heron Biotechnology, Bothell, Wash.) using sequences available on published databases. Thus, DNA fragments encoding each $V_H$ gene are, in some embodiments, generated independently for incorporation into targeting vectors, as described herein. In this way, multiple modified immunoglobulin heavy chain loci comprising a restricted number of $V_H$ gene segments are engineered in the context of mouse heavy chain constant regions. An exemplary targeting strategy for creating a restricted humanized heavy chain locus containing a human $V_H1$-2 gene segment, 27 human $D_H$ gene segments, and six human $J_H$ gene segments is shown in FIG. 2.

Briefly, a modified human BAC clone containing three human $V_H$ gene segments ($V_H6$-1, $V_H1$-2, $V_H1$-3), 27 human $D_H$ gene segments, and six human $J_H$ gene segments (see U.S. Ser. No. 13/404,075; filed 24 Feb. 2012, herein incorporated by reference) is used to create a restricted humanized heavy chain locus containing a human $V_H1$-2 gene segment. This modified BAC clone functionally links the aforementioned human heavy chain gene segments with the mouse intronic enhancer and the IgM constant region. The restricted human $V_H1$-2 based heavy chain locus is achieved by two homologous recombinations using the modified human BAC crone described above. In the first homologous recombination, 205 bp of the human $V_H6$-1 gene segment (from about 10 bp upstream (5') of the $V_H6$-1 start codon in exon 1 to about 63 bp downstream (3') of the beginning of exon 2) in the modified human BAC clone is deleted by bacterial homologous recombination using a spectinomycin (aadA) cassette flanked by unique PI-SceI restriction sites (FIG. 2, BHR 1). This allows for subsequent removal of the aadA cassette without disrupting other human gene segments within the restricted heavy chain locus. In the second homologous recombination, the 5' end of the modified human BAC clone including the entire human $V_H1$-3 gene segment and about 60 bp downstream (3') of the gene segment is deleted by homologous recombination using a hygromycin cassette containing flanking 5' AsiSI and 3' AscI restriction sites (FIG. 2, BHR 2). As described above, the spectinomycin cassette is optionally removed after confirmation of the final targeting vector including deletion of the two human $V_H$ gene segments flanking the human $V_H1$-2 gene segment (FIG. 2, bottom). An exemplary human V$_H$1-2 targeting vector is set forth in SEQ ID NO: 75.

Employing polymorphic V$_H$ gene segments in a restricted immunoglobulin heavy chain locus represents a novel approach for generating antibodies, populations of antibodies, and populations of B cells that express antibodies having heavy chains with diverse CDRs derived from a single human V$_H$ gene segment. Exploiting the somatic hypermutation machinery of the host animal along with combinatorial association with rearranged human immunoglobulin light chain variable domains results in the engineering of unique heavy chains and unique V$_H$/V$_L$ pairs that expand the immune repertoire of genetically modified animals and enhance their usefulness as a next generation platform for making human therapeutics, especially useful as a platform for making neutralizing antibodies specific for human pathogens.

Based on the final desired locus structure, one of the other human V$_H$ gene segments may be substituted in a similar fashion using human BAC clones containing the desired human V$_H$ gene segment. Thus, using the strategy outlined above for incorporation of additional and/or other polymorphic V$_H$ gene segments into the mouse immunoglobulin heavy chain locus allows for the generation of novel antibody repertoires for use in neutralizing human pathogens that might otherwise effectively evade the host immune system.

Targeted ES cells described above are used as donor ES cells and introduced into an 8-cell stage mouse embryo by the VELOCIMOUSE® method (supra). Mice bearing a humanized heavy chain locus containing a single human V$_H$ gene segment, all the human D$_H$ and J$_H$ gene segments operably linked to the mouse immunoglobulin constant region genes are identified by genotyping using a modification of allele assay (Valenzuela et al., supra) that detected the presence of the neomycin cassette, the human V$_H$ gene segment and a region within the human D$_H$ and J$_H$ gene segments as well as endogenous heavy chain sequences. Table 3 sets forth the primers and probes that are used to confirm mice harboring a restricted heavy chain locus containing a single human V$_H$1-69 gene segment, 27 human D$_H$ gene segments and six human J$_H$ gene segments.

Mice bearing an engineered heavy chain locus that contains a single human V$_H$ gene segment can be bred to a FLPe deletor mouse strain (see, e.g., Rodriguez, C. I. et al. (2000) High-efficiency deleter mice show that FLPe is an alternative to Cre-loxP. *Nature Genetics* 25: 139-140) in order to remove any Frt'ed neomycin cassette introduced by the targeting vector that is not removed, e.g., at the ES cell stage or in the embryo. Optionally, the neomycin cassette is retained in the mice.

Pups are genotyped and a pup heterozygous for a humanized heavy chain locus containing a single human V$_H$ gene segment, all the human D$_H$ and J$_H$ segments operably linked to the endogenous mouse immunoglobulin constant genes is selected for characterizing the immunoglobulin heavy chain repertoire.

TABLE 3

| Name (Region Detected) | Sequence (5'-3') | SEQ ID NO: |
|---|---|---|
| hyg (hygromycin cassette) | Forward: TGCGGCCGAT CTTAGCC<br>Reverse: TTGACCGATT CCTTGCGG<br>Probe: ACGAGCGGGT TCGGCCCATT C | 7<br>8<br>9 |
| neo (neomycin cassette) | Forward: GGTGGAGAGG CTATTCGGC<br>Reverse: GAACACGGCG GCATCAG<br>Probe: TGGGCACAAC AGACAATCGG CTG | 10<br>11<br>12 |
| hIgH9T (human D$_H$-J$_H$ genomic sequence) | Forward: TCCTCCAACG ACAGGTCCC<br>Reverse: GATGAACTGA CGGGCACAGG<br>Probe: TCCCTGGAAC TCTGCCCCGA CACA | 13<br>14<br>15 |
| 77h3 (human V$_H$1-69 gene segment) | Forward: CTCTGTGGAA AATGGTATGG AGATT<br>Reverse: GGTAAGCATA GAAGGTGGGT ATCTTT<br>Probe: ATAGAACTGT CATTTGGTCC AGCAATCCCA | 16<br>17<br>18 |
| mIgHA7 (mouse D$_H$-J$_H$ genomic sequence) | Forward: TGGTCACCTC CAGGAGCCTC<br>Reverse: GCTGCAGGGT GTATCAGGTG C<br>Probe: AGTCTCTGCT TCCCCCTTGT GGCTATGAGC | 19<br>20<br>21 |
| 88710T (mouse 3' V$_H$ genomic sequence) | Forward: GATGGGAAGA GACTGGTAAC ATTTGTAC<br>Reverse: TTCCTCTATT TCACTCTTTG AGGCTC<br>Probe: CCTCCACTGT GTTAATGGCT GCCACAA | 22<br>23<br>24 |
| mIgHd10 (mouse 5' V$_H$ genomic sequence) | Forward: GGTGTGCGAT GTACCCTCTG AAC<br>Reverse: TGTGGCAGTT TAATCCAGCT TTATC<br>Probe: CTAAAAATGC TACACCTGGG GCAAAACACC TG | 25<br>26<br>27 |
| mIgHp2 (mouse J$_H$ genomic sequence) | Forward: GCCATGCAAG GCCAAGC<br>Reverse: AGTTCTTGAG CCTTAGGGTG CTAG<br>Probe: CCAGGAAAAT GCTGCCAGAG CCTG | 28<br>29<br>30 |

Example 2

Reengineering of ADAM Genes into a Restricted Humanized IgH Locus

Mice with humanized immunoglobulin heavy chain loci in which the endogenous variable region gene segments (VDJ) have been replaced and/or deleted lack expression of endogenous ADAM6 genes. In particular, male mice comprising such humanized immunoglobulin heavy chain loci demonstrate a reduction in fertility. Thus, the ability to express ADAM6 was reengineered into mice with humanized, yet restricted, heavy chain loci to perpetuate the modified mouse strains using normal breeding methods.

Figure 3:
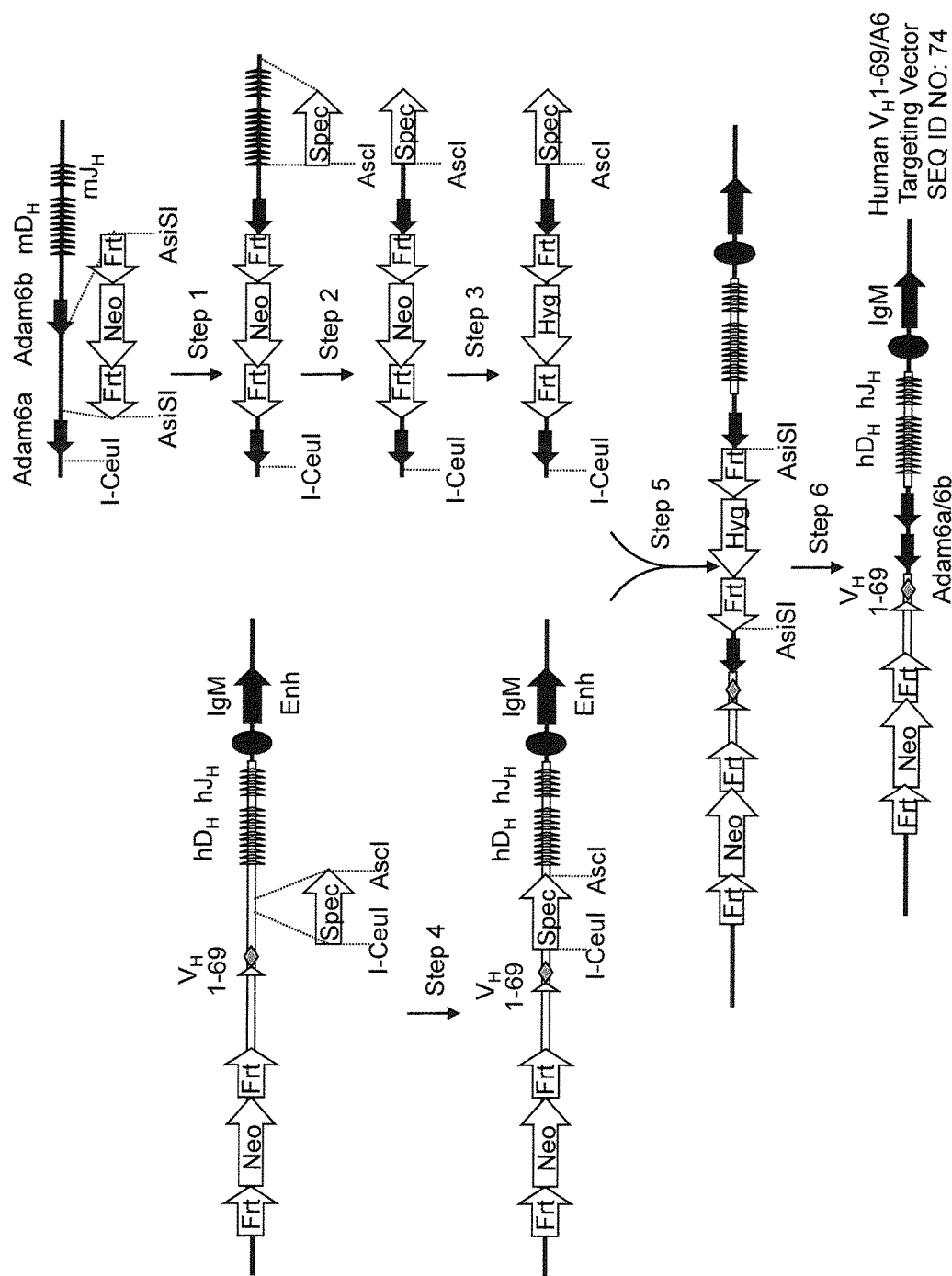
FIG. 3 shows a general illustration, not to scale, of a series of targeting and molecular engineering steps employed to make a targeting vector for construction of a modified heavy chain locus containing a single human $V_H$1-69 gene segment, twenty-seven human $D_H$, six human $J_H$ gene segments and an ectopic genomic fragment encoding mouse ADAM6 at an endogenous immunoglobulin heavy chain locus.

Reengineering of ADAM6 Genes into a Human $V_H$1-69 Restricted IgH Locus (FIG. 3).

A restricted immunoglobulin heavy chain locus containing a single human $V_H$1-69 gene segment located upstream of all the human $D_H$ and $J_H$ gene segments was reengineered to contain a genomic fragment encoding mouse ADAM6a and ADAM6b (SEQ ID NO: 77) by homologous recombination using BAC DNA. This was accomplished by VELOCIGENE® genetic engineering technology (supra) in a series of six steps that included modification of BAC DNA containing mouse and human sequences that yielded a final targeting vector containing a restricted humanized heavy chain locus contiguous with mouse heavy chain constant regions and mouse ADAM6 genes.

First, a mouse genomic fragment that encoded mouse ADAM6a and ADAM6b was prepared for insertion into a humanized heavy chain locus containing a single $V_H$ gene segments by a series of three bacterial homologous recombinations involving different selection cassettes to uniquely position restriction sites around the mouse ADAM6 genes (FIG. 3, Steps 1-3). In the first step, mouse BAC DNA containing a portion of the mouse immunoglobulin heavy chain locus was targeted with a neomycin cassette flanked by recombination sites, which was engineered to contain unique AsiSI restriction sites. In the second step, the modified mouse fragment containing mouse ADAM6 genes and the neomycin cassette was then targeted to delete the mouse $D_H$ and $J_H$ gene segments and replace them with a spectinomycin cassette that contained a unique AscI restriction site positioned 5' of the selection gene. In the third step, the double modified mouse fragment containing a neomycin cassette positioned between the mouse ADAM6 genes and a spectinomycin cassette was targeted to swap out the neomycin cassette for a hygromycin cassette. This was carried out so that the modified mouse genomic fragment containing the ADAM6 genes could be inserted by ligation of compatible genomic fragments into a humanized heavy chain locus containing the single $V_H$ gene segment.

In step four, a humanized heavy chain locus containing a human $V_H$1-69 gene segment, 27 human $D_H$ gene segments, and six human $J_H$ gene segments was separately targeted by bacterial homologous recombination with a spectinomycin cassette containing unique I-CeuI and AscI restriction sites at 5' and 3' locations in the cassette, respectively (FIG. 3, top left). Following this step, the modified genomic fragment containing a restricted humanized heavy chain locus, neomycin and spectinomycin cassettes and the modified mouse fragment containing the ADAM6 genes, hygromycin and spectinomycin cassettes were separately digested with I-CeuI and AscI restriction enzymes to create modified genomic fragments for ligation (FIG. 3, middle). In step five, the appropriate digested genomic fragments were purified and ligated together to yield a reengineered humanized heavy chain locus containing a single human $V_H$ gene segment, 27 human $D_H$ gene segments, six human $J_H$ gene segments and an integrated mouse genomic fragment encoding ADAM6a and ADAM6b with neomycin and hygromycin resistance. In the final step (Step 6), the hygromycin cassette was deleted by AsiSI digestion followed by relegation of the compatible ends.

This step produced the final targeting vector for reinsertion of mouse ADAM6a and ADAM6b sequences into a restricted humanized heavy chain locus, which contained, from 5' to 3', a 5' homology arm containing about 20 kb of mouse genomic sequence upstream of the endogenous heavy chain locus, a 5' Frt site, a neomycin cassette, a 3' Frt site, about 8.2 kb of the human $V_H$1-69 promoter, the human $V_H$1-69 gene segment with a modified 3' RSS, a mouse genomic fragment containing about 17711 bp of mouse genomic sequence including mouse ADAM6a and ADAM6b genes (SEQ ID NO: 77), a human genomic fragment containing 27 human $D_H$ and six human $J_H$ gene segments, and a 3' homology arm containing about 8 kb of mouse genomic sequence downstream of the endogenous heavy chain locus including the intronic enhancer and the IgM constant region gene (Human $V_H$1-69/A6 Targeting Vector, SEQ ID NO: 74; FIG. 3, bottom).

Figure 4:
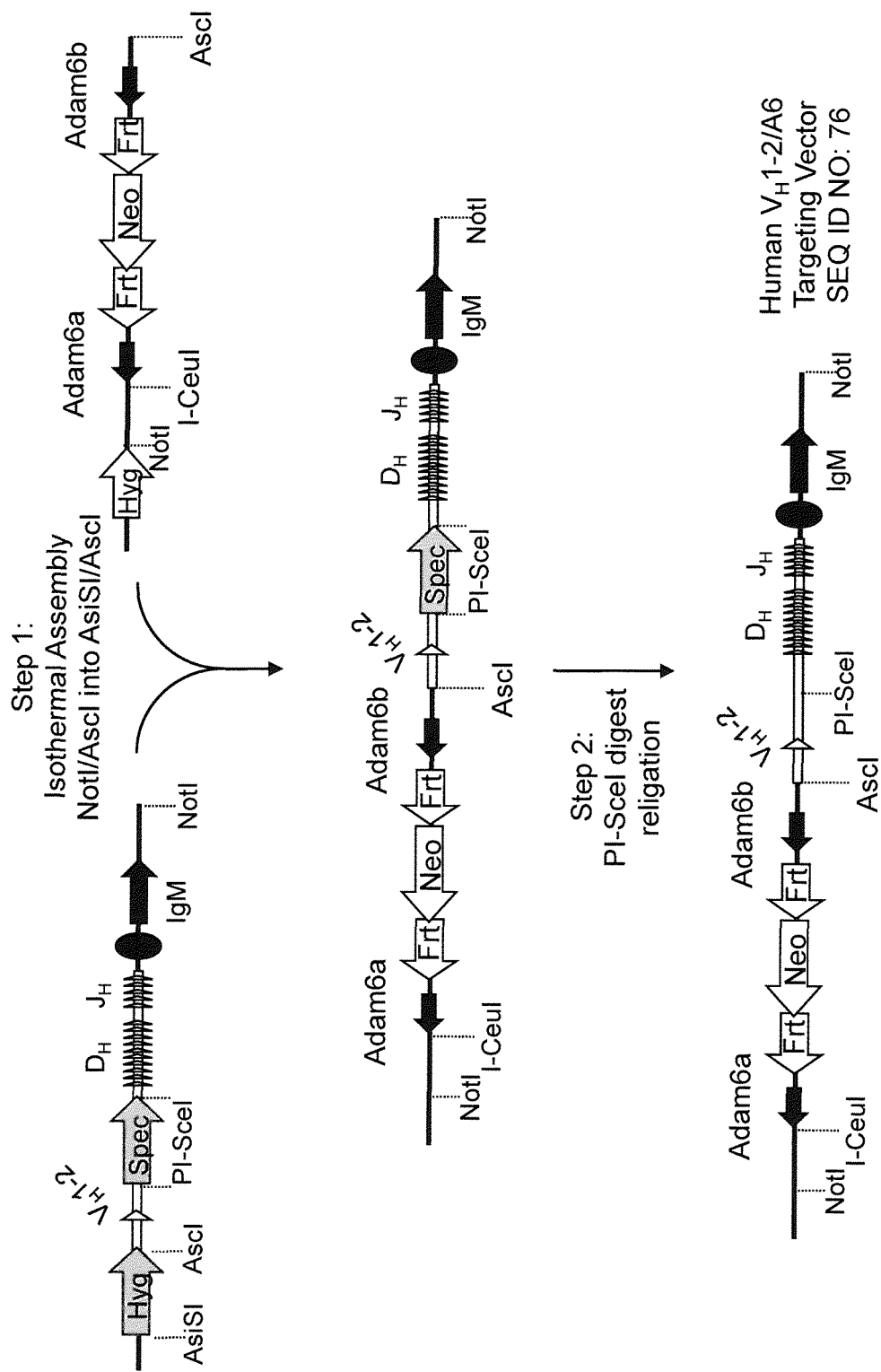
FIG. 4 shows a general illustration, not to scale, of a series of targeting and molecular engineering steps employed to make a targeting vector for construction of a modified heavy chain locus containing a single human $V_H$1-2 gene segment, twenty-seven human $D_H$, six human $J_H$ gene segments and an ectopic genomic fragment encoding mouse ADAM6 at an endogenous immunoglobulin heavy chain locus.

Reengineering of ADAM6 Genes into a Human $V_H$1-2 Restricted IgH Locus (FIG. 4).

A restricted immunoglobulin heavy chain locus containing a single human $V_H$1-2 gene segment located upstream of all the human $D_H$ and $J_H$ gene segments is reengineered to contain a genomic fragment encoding mouse ADAM6a and ADAM6b (SEQ ID NO: 73) by homologous recombination using BAC DNA. This was accomplished by VELOCIGENE® genetic engineering technology (supra) in a series of steps that included modification of BAC DNA containing mouse and human sequences that yielded a final targeting vector containing a restricted humanized heavy chain locus contiguous with mouse heavy chain constant regions and mouse ADAM6 genes.

A modified human BAC clone containing a single human $V_H$1-2 gene segment flanked by 5' hygromycin and 3' spectinomycin cassettes, 27 human $D_H$ gene segments, six human $J_H$ gene segments, a mouse heavy chain intronic enhancer, and a mouse IgM constant region (described above in Example 1) was modified to contain a genomic fragment encoding mouse ADAM6 genes. This is accomplished by a modified isothermic DNA assembly method referred to herein as oligo-mediated isothermal assembly, which is based on the method described in Gibson et al. (2009, Enzymatic assembly of DNA molecules up to several hundred kilobases, *Nature Methods* 6(5):343-345; herein incorporated by reference). This modified method does not require sequence identity between the ligated fragments. Instead, sequence identity is imparted by an oligo that serves to join the two fragments. Further, the clip serves as a template that adds sequence identity to the end of one of the fragments. The extended fragment enables hybridization with the second fragment. Specifically, oligo-mediated isothermal assembly was employed to replace the hygromycin cassette with a NotI-AscI fragment containing a 20 kb distal mouse IgH homology arm, the mouse ADAM6a gene, a neomycin cassette flanked by Frt sites, and the mouse ADAM6b gene.

Briefly, the modified human BAC clone containing a restricted human $V_H$1-2 heavy chain locus (FIG. 4, top left) is digested with AsiSI and AscI to remove the hygromycin cassette, and a modified mouse BAC containing the mouse ADAM6 genes (FIG. 4, top right) is digested with NotI and AscI to remove the fragment containing the 5' mouse arm and release the mouse ADAM6 genes flanking the neomycin cassette. The two digested BAC fragments are subsequently mixed together with 5' and 3' joiner oligonucleotides and incubated for 1 hour at 50° C. in an assembly reaction mixture (T5 exonuclease, Phusion DNA polymerase, Taq DNA ligase, 10 mM DTT, 5% PEG8000 (w/v), 1 mM NAD, 0.2 mM dNTPs, 10 mM $MgCl_2$, and 100 mM Tris-HCl). The 5' joiner oligo contains a 38 bp overlap with sequence 5' of the AsiSI site of the modified human BAC clone containing human $V_H$1-2, and a 30 bp overlap with the NotI site and adjacent 3' sequence of the modified mouse BAC clone containing ADAM6 genes. The 3' joiner oligo contains a 26 bp overlap with sequence 5' of the AscI site of modified mouse BAC clone containing ADAM6 genes, an AscI site, and a 35 bp overlap with sequence 3' of the AscI site of the modified human BAC clone containing human $V_H$1-2. The assembly reaction is transformed into *E. coli* and the correct product is selected with kanamycin and spectinomycin selection. To create the final targeting vector, the spectinomycin cassette is removed by PI-SceI digestion followed by religation.

The final targeting vector contains, from 5' to 3', a 20 kb distal mouse IgH homology arm, a mouse ADAM6a gene, a 5' Frt site, a neomycin cassette, a 3' Frt site, a mouse ADAM6b gene, a ~18 kb human genomic fragment, a human $V_H$1-2 gene segment, a ~46.6 kb human genomic fragment, an inactivated human $V_H$6-1 gene segment, 27 human $D_H$ gene segments, six human $J_H$ gene segments, and an 8 kb 3' mouse homology arm containing a mouse IgH intronic enhancer and IgM constant region (SEQ ID NO: 76)

Each of the final targeting vectors (described above) were used to electroporate mouse ES cells that contained a deleted endogenous heavy chain locus to created modified ES cells comprising a mouse genomic sequence ectopically placed that comprises mouse ADAM6a and ADAM6b sequences within a restricted humanized heavy chain locus. Positive ES cells containing the ectopic mouse genomic fragment within the humanized heavy chain locus were identified by a quantitative PCR assay using TAQMAN™ probes (Lie and Petropoulos, 1998, Advances in quantitative PCR technology: 5' nuclease assays, *Curr Opin Biotechnol* 9(1):43-48).

Targeted ES cells described above were used as donor ES cells and introduced into an 8-cell stage mouse embryo by the VELOCIMOUSE® mouse engineering method (see, e.g., U.S. Pat. Nos. 7,698,442, 7,576,259, 7,294,754). Mice bearing a humanized heavy chain locus containing a restricted number of human gene segments and an ectopic mouse genomic sequence comprising mouse ADAM6a and ADAM6b sequences were identified by genotyping using a modification of allele assay (Valenzuela et al., 2003) that detected the presence of the mouse ADAM6a and ADAM6b genes within the restricted humanized heavy chain locus as well as human heavy chain sequences.

Pups are genotyped and a pup heterozygous for a restricted humanized heavy chain locus containing an ectopic mouse genomic fragment that comprises mouse ADAM6a and ADAM6b sequences is selected for characterizing mouse ADAM6 gene expression and fertility.

SEQUENCE LISTING (77 sequences)

SEQ ID NO: 1 - protein, 754 aa, Mus musculus
MLSLTWGMRLVERPVVPRVLLLLFALWLLLLVPVWCSQGHPTWRYISSEVVIPRKEIYHTKGLQAQRLLSYSLRFRGQRHIIHLRRKTLIWPRHLLLTTQDDQGALQMEYPFFPVDCYYIGYLEGILQSMVTVDTCYGGLSGVIKLDNLTYEIKPLNDSQSFEHLVSQIVSESDDTGPMNAWKHWSHNTGSPSSRLEYADGAPRLSSKNYATHPAAIKGHFQATHSVYSASGGDKLSSTVEYLFKVISLMDTYLTNLHMRYYVFLMTVYTEADPFSQDFRVPGGQAHTFYERVFYAHFRPDAGAIINKNSPGDDAVNPAERSICSPSALICLGQHGRNPLFLSIIITNRVGRSLGLKHDEGYCICQRRNTCIMFKNPQLTDAFSNCSLAEISNILNTPDLMPCLFYDRHVYYNTSLTYKFCGNFKVDNNEQCDCGSQKACYSDPCCGNDCRLTPGSICDKELCCANCTYSPSGTLCRPIQNICDLPEYCSGSKFICPDDTYLQDGTPCSEEGYCYKGNCTDRNIQCMEIFGVSAKNANIKCYDINKQRFRFGHCTRAEESLTFNACADQDKLCGRLQCTNVTNLPFLQEHVSFHQSVISGVTCFGLDEHRGTETADAGLVRHGTPCSRGKFCDRGACNGSLSRLGYDCTPEKCNFRGVCNNRRNCHCHFGWSPPKCKEEGHSGSIDSGSPPVQRRIIKQNLEPVVYLRILFGRIYFLFVALLFGIATRVGVTKIFRFEDLQAALRSWQEQAKDK

SEQ ID NO: 2 - protein, 756 aa, Mus musculus
MLSLTWGMRLVERPVVPRVLLLLFALWLLLLVPVWCSQGHPTWRYISSEVVIPRKEIYHTKGLQAQRLLSYSLHFRGQRHIIHLRRKTLIWPRHLLLTTQDDQGALQMDYPFFPVDCYYIGYLEGIPQSMVTVDTCYGGLSGVMKLDDLTYEIKPLNDSQSFEHLVSQIVSESDDTGPMNAWKHWSHNTGSPSSRLEYADGAPRISSKNYATHPAAIKGHFQATNSVYNSAAGDKLSSTVGYLFQVISLMDTYLTNLHMRYYVFLMTVYTNSDPFRLEFAVPGGSAYNYYVSVFYNKFKPDAGVLLNKYGPQDNQVNPAERSICSSLALICIGKYDRNPLFLSPIITNRVGRSLGLKYDEGYCVCQRRNTCIMFRHPQLTDAFSNCSLAEISNILNTPGLMPCLFYDRHVYYNTSLTYKFCGNFKVDNDEQCDCGSQKACYSDPCCGNDCRLTPGSICDKELCCANCTYSPSGTLCRPIQNICDLPEYCNGTKYICPDDTYLQDGTPCSEDGYCYKGNCTDRNIQCMEIFGVSAKNANIKCYDINKQRFRFGHCTRAEESLTFNACADQDKLCGRLQCTNVTNLPYLQEHVSFHQSIISGFTCFGLDEHRGTETTDAGMVRHGTPCSKSKFCDQGACSGSLSHLGYDCTPEKCSFRGVCNNHRNCHCHFGWKPPECKEEGLSGSIDSGSPPVQRHTIKQKQEPVVYLRILFGRIYFLFVALLFGIATRVGVTKIFRFEDLQATLRSGQGPARDKPK

SEQ ID NO: 3 - DNA, 16790 bp, Mus musculus
taactataacggtcctaaggtagcgagggatgacagattctctgttcagtgcactcagggtctgcctccacgagaatcaccatgccctttctcaagactgtgttctgtgcagtgccctgtcagtggaaatctggagagcatgcttccatgagcttgtgagtagtatatctagtaagccatggctttgtgttaatggtgatgttctacataccagttctctggcttaataatgaggtgatgattctatgttcctgtaacgcttcctcaactgggtcctaagtctttcttcactccatctattcctctaaggaatgatcctgaaaatcccatcacaaactataggagatgggaaccatcaaaaaacacagtgacaaagaggtgggaacgcatcagggttcaggaaccatattttaaaaagatatcgtaaataacttcttaaaagagatatagacaaatctccattaatacggagaccagaggcctaaggctaagaaccaatggtggctcaaggtctcctgctacccgaggagcaaacgtagagcagtttctaatgatttatttaaaatatagaatcaaaagtaccagtttgcaattttgaaagatttatttcagcaatgcaacaacatcaggtggtgccgagtccaacacgtcttatgtcccatgatataaacaaaggccatccagaactgtggactggagttctaccttgtcccctaatgacattcagattttttttccattctctttatcttagaggagacagggggctaactcattttacttgtcctttgcttgttcttgccaagaacgtaaagcagcttgcaagtcttcaaacctaaatatcttagtaactcctacacgagtggcaatgccaaagagcagtgcaacaaagaggaagtaaatacgaccaaagagtattcttaaatacactactggctctaggttctgttttattatgcgcctttgaaccggaggggacccactgtctatgctcccactgtgtccctcttctttgcactttggagggctccaaccaaaatggcaatggcaattccgacgattgttacacactcctctgaaattgcatttttctggggtgcagtcataacccaaacgagataaacttccattgcaagctcctcgatcacagaacttaccccttgaacacggggtaccatgtctcaccaatccagcatctgctgtttctgtcccacgatgttcatcaagcccaaagcaggtaaccccagagataaccgattgatggaatgaaacatgttcttgcaaaaatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccctcttctgagcatggtgtcccatcttgcagataagtgtcatctgggcaaatgaacttagagccactacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcattgttatctactttgaagtttccacaaaacttataagtcaatgatgtattataataaacatgacggtcatagaaaagacatggcatcagatcaggagtattaagtatgttgcttatctctgcaagggaacaattgctgaaagcatctgttaattgaggatttttgaacatgatgcaggtgttccttctctggcagatacagtacccctcatcatgttttaggcctaaactccttccaacacgattggttattataatagataaaaataaaggatttcgaccatgttgaccaagacaaattagggctgagggagaacatatactcctctcagctggattaacagcatcatctcctggcgaattcttgttaattatagctcctgcatcaggcctaaaatgagcataaaatactctctcatagaaagtatgagcctgccctcctggaactcgaaaatcttgtgaaaatggatcagcctcggtatacacagtcatgagaaagacatagtaccgcatatgaagattggtcagataggtgtccattaaactaatgactttaaacaaatactcaacagtagatgaaagtttgtcacctccagaagcactatatacagaatgggttgcttgaaagtggccttttatagcagctggatgtgtagcgtaattcttactagatagtctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggttatccaactttatgacccctgacaggcccccataacaagtatccacagtgaccatggattgcaggatcccctccaggtagccaatatagtaacaatctacaggaaaaaaggggtactccatctgtaaggctccttggtcatcttgagttgtcagcaacaagtgtctgggccaaatgagtgtctttctccgcaggtggatgatatgtctctggccccgaaaacgcaagctatacgagagcagtctttgtgcttgaagtcctttggtatggtagatctccttccgaggaataaccacctccgatgagatgtaacgccaagtgggatggccttgagaacaccagactggaaccaggaggagcagccagagtgcaaatagcaagaggaggaccctggggaccacaggtctttccactagcctcatgccccaggtcagagataacatcctgggtggagctaactccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttttcacagttgttctaacttcttgttttgttttgtttgtttgtttgtttgaaagttagaagtaaatactgtctatattagccttttagctataaatgattgtttttatttcttctaatcatgttttgtttgagttttggttaaactatttacaaatgagttttttttttccttttgggtgttgctcgaaagtttggagctttctgttaatattgtgttgttgtttctccaatattattagacctgagaattctacctgggtacctgtgaactccagaatttttaaaaattccatctcttgggaacattatctctgaccccgtctgaggccgaagtggctgtccccctccaacctttagtatctttctttcctgactattgggatttcttcaagcaatcaggctgatgggttctcagcagtgagaccagtagactgtcggtatgaacgtcgaagagtctgccacacactccgggttcatcaacagtgctttcgcgtctcttacttttgtagaaggaaatgcagcctctgagttttctccaagaaatcattgatgaaagggtgaaaagatgggtatcacccggagttcatgacaagccctggctcagacacgtgagcaaggtctacagccccaaagataggctgccctgcaacatgtatttataagataggagaaaaaaatgggtagttggagggttgatcaacttacttcctctcaaacatatatatctcatctaagtgtgcaggggaaaactctgtagaactactgggatacctgctcacccccaggagcctcatgaataagtctctgcttctgccttgtagccatgagcattactgcacctgatacccctgcagcttcctagggaagagggaggaagtgacttggcccctgtctggttaaggtaagaggagataaatcccttctcattgattagggtgagaggggtcatgtgctctatcattggtgacccagttgggacatgggtttataccaaagtcatcactctgaggttctgtgtaccaccaggctgaactcccatatcctacatggacataggacaacaccaagcagaaggaggttttaggactaaactgaaggacagagatgcggtttctaaacaactagggagtgccagggccagcctctctaaccactataggacactgtggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaagggagggagggagagagagagaaggctaagtctttccatacctgggtcccaatacctcttataacccaagcacatggtttcacatatcacaatgcggttgggatatagataactgtaaatacttgtgaaaataatggggctgagatctggggttttcatgatagtttcaaagtcaccgtactgactaaaaccttccactggcccatctccagcttcctaatctgagggtatcaaatttcccactaagtgtgtttagaaagatctccacctttttgcccttgtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaaaggtaggcatgtagaagctgaagcatctcacctcattccaagcaccctcagtctctaaatgtgcccccttgtttccagaagtgcaacctcaagcatcttttattcattcatcttagagggccacatgtgctgtagtgttataagatgaaatttaaagcattaattattcctaacaagccaattaaacaagccaaaaacattcatcagtcattcccatggaacctctgaagcatcttcctgctctaaccttgggttttccagggctgctctgggatcacaggagctgtcctgtctaccagccatataaaggcagacctatcagaattacaccagacttctcaccatagactataaaagccagaatatcctggacagatgttatacagaaactaagagaacacaaatgccagcccaggctactatacccagcaaaactctcaattaccatcgatgaagaaaccaagatattccattacaagtccaaatttacacaatatctttccataaatccagccctacaaaggatagcagatggaaaactccaacacaggtaggaaaactacaccctagaaagagcactaaagtaatcatctttcaacacactcaaaagaagataaccacacaaacataattccacctctaacaacaaaaataaagtaggcaacaatcactattccttaatatctcttttaacatcaatggactcaattctccaataaaaagacatagactaacagactgaatacataaacaggacacagcattttgctgcataaagcaaacacagcgttacttttttttttctaaatgacattttttattagatattgtctttattgacatttcaaatgttatcccctttcctggtttaccctctgaaatcccctatctcctccccctccccctgctcaccaatccacccactcccacttccaggccctggcaatcccctatatttgggcatagagccttcacaggaccaaggtactctccttgcattgatgaccaactagtccattctctgctacaaatgcagctagatctatgagtcccaccatgttttcttttgttggtggtttcatgccagggagctcttggagtactgattggttcatattgttgttctccctatggggttacaaaacccttcaacttcttgggtcctttctctggctgcctcattggggaccttgtgcgaagtccaatggatgactgtgagcatccacttctgtatttgccaggcactggcagagcctctcagaagacagctatatcaagatcctggcagcaagctcttgttggtatccacaaaagtgtctggtggttgtctatgggatggatccccaaaggggcagtctctggatggtcattccttcagtctctgttccacactttgtctctttaactccttccatgactattttattcctccctctaagaaggaccgaagtattcatactttggtcttccttcttgaaattcatgtgttttgtgaattgtatctttgatattccgaacttctgggctaatatccacttatcagtgagtgaatatcatgtgtgttcttatgtgattgagttacctcactcaggatgatatcctccagaaccatccatttgtctaagaatttaatgaattcattgtttttaatagctgaggagtactccattgtgtaaatgtaccacattttctgtacccattgttctcttgagggacatctgggttctttaaagcttctggacattaaatataaggctgctatggaaatagtggagaatgtgtccttattacatgttggagcatcttctgggtatatgcccaggagtgctattgctggatcctctgatagtactatgtccaattttctgaggaactgccaaactgatttacagagtggttgtaccagcttgcaattccaccagcaatggagaaatgttccccttcctccacatcctcaccaacatctgctgtcacctcaatttgttcttagtgattcagacaggtgtgaggtggaatatcagggttgtttggcatttccctgatgactagtgatattgaaaaaaattttaagtgtttctcagccattcagtattcttcagttgagaattcactgtttagctctgtactcaggtttttttaatagggttatttggttttctggagtctaacgtcttgaattctttctatatattggatattagccctctgtcatatttaggattggtaaagatctttcccaatatgttggctgcctttttgtgtcctttgccttacagaacctttttaattttatgaggtcccatttgctaattcttcattttacagcacaagccattggtgttctgttcaaaaatctttccccctgaaccctatcttcgaggatcttccccactttctcctctataagtttcagtgtctctattattgtgctgaggggtaccgaagttcctattccgaagttcctattctctagaaagtataggaacttctcgcgcgtctggcctccgaggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtcctagattgggaacccgggtctctcgaattgttgacaattaatcatcggcatagtatatcggcatagtataatacgacaaggtgaggaactaaaccatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagagaagttcctattccgaagttcctattctctagaaagtataggaacttcctagggtttaaacccgcggtggagctctgatgtgggaacgcttcagtgttcaggaaccatatgatttatttaaaatatagaatcaaaagtaccaatttgcagttttgaaagatttattccagtgtaagcattagcaatgcaccaacatcaggtgatttctgaatccaacacgtcttatgtcctcatgatattaaaaaaaaaaaaaggccatccagaactgtgaacttgagttctaccttgttccctactgacattcagattttcttttttgcattctctttatcttacaggagacaggaggggagggctaactcattttactttggcttgtcccttgctggtccttgcccagaacgtaaagtagcttgcaagtcttcaaatctaaaaatcttagtaactcctacacgagtggcaatgccaaagagcagtgcaacaaagaggaagtaaatacgaccaaagagtattcttaaatacaccactggctcttgtttttgttttattgtgtgcctttgaactggaggggacccactgtctatgctcccacttagtccctcttctttgcactctggaggcttccaaccaaaatgacaatggcaattccgatgattgttacacactcctctaaaactgcatttttctggggtgcagtcataacccaaatgagataaacttccactgcaagctccttgatcacagaacttacttttggagcagggggtaccatgtctcaccattccagcatctgttgtttctgtcccacgatgttcatcaagcccaaagcaggtaaacccagagataatcgattgatggaatgaaacatgttcttgcaaatatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccatcttctgagcatggtgtcccatcttgcagataagtgtcatctgggcaaatgtatttagtcccattacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcatcgttatctactttgaagtttccacaaaacttataagtcaatgatgtattataataaacatgacggtcatagaaaagacatggcatcagaccaggagtattaagtatgttgcttatctctgcaagggaacaattgctgaaagcatctgttaattgaggatgtctgaacataatgcaggtgttccttctctggcagacacagtacccctcatcatattttaagcctaaactccttccaacacgattggttattataggagataaaaataaaggatttcgatcatatttaccaatacaaattagggctaaggaagaacatatactcctctcagctggattaacctggttatcttgtggcccatacttattaagtaaaactcctgcatcaggcttaaatttattataaaagactgacacatagtaattataagccgaccctcctggaactgcaaactcaagtcgaaatggatcagaattggtgtacacagtcatgagaaagacatagtaccgcatatgaagattggtcagataggtgtccattaaactaatgacttgaaacaaatacccaacagtagatgaaagtttgtcacctgcagcagaattatatacagaattggttgcttgaaagtggccttttatagcagctggatgtgtagcgtagttcttactagatattctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggtcatctaacttcatgacccctgacaggcccccataacaagtatccacagtgaccatggattgtgggatcccctccaggtagccaatatagtaacaatctacaggaaaaaaggggtaatccatctgtaaggctccttggtcatcttgagttgtcagcaacaagtgtctgggccaaatgagtgtctttctccgcaggtggatgatatgtctctggccccgaaaatgcaagctatatgagagcagtctttgtgcttgaagtcctttggtatggtagatctccttccgaggaataaccacctccgatgagatgtaacgccaagtaggatggccttgagaacaccagactggaaccaggaggagcagccagagtgcaaatagcaagaggaggaccctggggaccacaggtctttccactagcctcatgccccaggtcagagataacatcctgggtggagctaaatccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttctcacagttgttctaatttcttgttttgttttgtttgtttgtttgaacgttagtagtaaatactgtctatattagccttttagctataaatgattgtttttatttcttctaatcatattttgtttgagttttggttaaactatttacaaatgagttttttttttttccttttgggtgttgctcgaaagtttggagctttctgttaatattgtgttgttatttttccaatattattagacctgagaattctatctgggtacctgtgaactctagaatttttaaaaattccatctcttgggaacattacctctgaccccgtctgaggccgaagtggctgtccccctccaacctttagtatctttctttcctgactattgggatttcttcaagcaatcaggctgatgggttctcagcagtgagaccagtagactgccggtatgaacgtcgaagagactgccacacactccaggttcatcaacagtgctttcgcgtctcttacttttgtagaaggaaaagcagcctctgagttatctccaagaaatcattaatgaaagagttaaaagatgggtatcacccggagttcatgacaagccctggctcagacacgtgagcaaggtctacagccccaaagataggctgccctgcaacatgtatttataagatagaagaaaaaaatgggtggttggagggttgatcaacttacttcctctcaaacatatatatctcatctaagtgtgcaggggaaaactctgtaggactactgggattgttattatcattattattattattattattattattattattattattattattaacttaaggcattttattagatattttcttcatttagttttcaaatgttatccccggaacctcctatactctctccctgccctgctccccaacccacccactcctacatcctggccctggcattcccctatactgtggcagatgatcttcgtaagaccaagagcctttcctcccattgatggcctactaggctatcctcttttacatatgcaactagagtcacagctctggggaggtattgcttagttcatattgtttttcctcctatagggttgcagatccctttagctccttgggtactttctctagctcctccattgggggccctgtgttccatccaatagatgactgtgagcatccacttctgtatttgccaggtattggcatggatcttactgcaccttctgaactctctaagcagctttcctggtcacctccaggagcctcatgaataagtctctgcttcccccttgtggctatgagcattactgcacctgatacaccctgcagcttcctagggaagagggaggaagtggcttggcccctgtctggttaaggtaagaggagataaatcccttctcatgaattagggtgagaagggtcatgtgctctatcattggtgaccaacttggggacatgggcttatacagtcatcactctgaggctctgtgtaccaccagactgaactcccatatcctacatgcacataggacaacaccaagtagaaggaggttttaggactaaactgaaggacagagatggggtttctaaacaactagggagtgccagggccagcctctctaaccactataggacactatggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaaaggagggagggagagagagagaaggctaagtctttccatacctgggtcccaatacctcttataacccaagcacatggtttcagatatcacaatgcggttgggatatagataactgtaaatacttgtgaaaataatggggctgagatctggggttttcatgatagtttcaaagtcactgtactgactaaaaccttccactggcccatctccagcttgttaatctgagggtatcaaatttcccactaagtgtgtttagaaagatctccacctttttgccctagtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaagggtaggcatgtagaagctgaggcatctcatctcactctaagcaccctcagtctctaaatgtgcccctttgtttccagcagttcagcctcaagcatcttttattcactcgtcttagagggacacatgtgctgtagtgttataagatgaaatttaaagcattagttattcccaacaagccaattaaacaagccaaaaacattcatcagtcattcccatggaacctctgaagcatcttcctgctctaaccttgagtttcctagggctgctgtgggatcacaggagctgtcctgtttaccagcctatcctgtcccacgggattcagttattagtgggtgcgagggggaccgcaaacctggaagaaaatgggattggaagagaaaagagaaacgaagaccaagtagatcttttcctatcaaggtcttcgtttattaggctgaggtgcctggtgtaaagcatgcatcgcggggaataggaaggggtcgagggggaattttacaaagaacaaagaagcgggcatctgctgacatgagggccgaagtcaggctccaggcagcgggagctccaccgcggtggcgccatttcattacctctttctccgcacccgacatagat

SEQ ID NO: 4 - DNA, 872 bp, Homo sapiens
gcaggatttagggcttggtctctcagcatcccacacttgtacagctgatgtggcatctgtgttttctttctcatcgtagatcaggctttgagctgtgaaataccctgcctcatgcatatgcaaataacctgaggtcttctgagataaatatagatatattggtgccctgagagcatcacataacaaccacattcctcctctaaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagacacagtgtgaaaacccacatcctgagagtgtcagaaaccctgagggagaaggcagctgtgccgggctgaggagatgacagggtttattaggtttaaggctgtttacaaaatgggttatatatttgagaaaaaaagaacagtagaaacaagtacatactcctctaattttaagataattattccattcaagagtcgtaatat

SEQ ID NO: 5 - protein, 118 aa, Homo sapiens
MDWTWRFLFVVAAATGGVQSQVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 6 - DNA, 99294 bp, Artificial Sequence
  Description of Artificial Sequence: Synthetic polynucleotide
aagcttatctctctgttgctcagactcatctaggaatttcagaaatttctgttctagcatctcttccagcttttgtctccaaccctcattctcttctttctttttttttttaaattatatgttctctgtctttttaaaaaactttttaaaattaggtatttatgtcatttacatttccaatgctatcccaaaagtcccacccacgctccccaacccactatcccacccacccactcccacttcttggccctggcattcacagtgtactgagacatataaagtttgcacaaccaatgggcctctctttccactgatggccgactaggccatcttctgatacatatgcagctagagacacgagattctgggggtactggttagttcatattgttgttccacctatagggttgcagatccttttagctccttgggtactttctctagctcctccattgggggccctgtgatccatccaatagctgactgtgagcatccacttctgtgtttgctaggccccagatagtctcacaagagacagctatatctgggtcctttcagcaaaatcttgctagtgtatgcaacggtgtcagagtttggaagctgattatgggatggatccccggatatggcattctctagttggttcatccttttgtctcagctccaaactttgtctctgtaactccttccatgggtgttttgttcccagttctaaggaggggcaaagtatccacactttggtcttcattcttcttgagtttcatgtgttttgcaaattgtatcttatatcttgggtattctaagtttctgggctaatatccacttatcagtgagtacacattgtgtgagttcttttgtgattgggttacctcactcagtatgatgccctccaggtccatccatttgcctaggaatttcataaattcattctttttaatagctcagtagtactccattgtgtagatgtaccacattttctgtattcattcctctgttgaggggcatctgggttctttccagcttctggctattataaataaggctgctatgaacatagtggagcatgtgaccttcttaccggttgggacatcttctggatatatgcccaggagaggtattgctggatcttccggtagtactatgtccaattttctgaggaactgacaaactgatttccagagtggttagtaccagcttgcaatcccaccaacaatgagaggagtgttcgtctttctccacatcctcaccagcatgctgctgtcacctgaatttttgatgcttagccattctgactggtgtgaggtggaatctcagggttgttttgatttgtatttccctgatgattaaggatgctgaacattttctcaggtgcttctcagccattcagtattctttaggtgagaattctttgtttagctctaagccccatttttttaatggggttatttgattttctggagtccaccttcttgagtttttttttccattttttattacataatttcctcaattacatttccaatgctatcccaaaagtcccccataccctcccccccccaattccctacccaccccttcccatttttttggccctggcgttcccctgtactggggcatataaagtttgtgtgtccaatgggcttctctttccagtgatggctgactaggccatcttttgatacatatgcagctagagtcaagagctcccgggtactggttagttcataatgttgttccacctatagggttgcagatccctttagcttcttgggtactttctctagctcctccattgggagccctgtgatccatccaatagctgactgtgagcatccacttctgtgtttgctaggccccggcatagtctcacaagagacagctacatctgggtccttttgataaaatcttgctagtgtatgcaagggtgtcagcatttggaagctgattatggggtggatccctggatatggcagtctctacatggtccatccttttgtctcagctccaaactttgtctctgtaacttcttccatgagtgttttgttcccaattctaaggaggggcatagtgtccacacttcattcttcattcttcttgagtttcatgtgtttagcaaattgtatcttatatcttgggtatcctaggttttgggctaatatccacttatcagtgagtacatattgtgtgagttcctttgtaaatgtgttacctcactcaggatgacgccctccaggtccatccatttggctaggaatttcataaattcattctttttaatagctgagtagtactccattgtgtaaatgtaccacattttctgtactcattcctctgttgaggggcatctgggttctttataggttctggctattataaataaggttgctatgaacatagtggagcatgtgtccttcttaccggttgagacatcttctggatatatgcccaggcgaggtattgctggatcctccggtagtactatgtccaattttctgaggaactgccagactgatttccagagtggttgtacaagcctgcactctcaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacatttttttcaggtgcttctctgccattcggtattcctcaggtgagaattctttgttcagttctgagccccattttttaatggggttatttgattttctgaagtccaccttcttgagttctttatatatgttggatattagtcccctatctgatttacgataggtaaagatcctttcccaatctgttggtggtctttttctcttattgacggtgtcttttgccttgcagaaactttggagtgagttctttatatatattggatattagtcccctatctgatttaggataggtaaagatcctttcccaatctgttggtgacctttttgtcttattgacggtgtcttttgccttgcagaatctttgcaattttatgaggtcgcatttgtcaattctcgatcttacagcacaagtcattgctgttctgttcaggaatttttcctctgtgcccatatcttcgaggcttttacctgctttctcctctatatgtttgagtgtctctggtttaatgtggagttccttaatccacttagatttgaccttagtacaaggagataggaatggatcaattcgcattcttctacatgataaccgctagttgtgccagcaccatttgttgataatgctgtcttttttccactggatggtttttgctcccttgtctaagatcaagtgaccataggtgtgtgggttcatttctgggtcttcaattctatttcattggtctacttgtctgttgttataccagtaccatgcagattttatcacaattgctctgtagtagagttttaggtcaggcatggtgattacaccagaggttttttttatccttgagcagagtttttgctatcctaggttttgtgttatttcagatgaatttgcagattgccctttccagttcgttgaagaattgagttggaattttgatggggattgcattgaatctgtagattgctttggcaatatagccatttttactatattgatcctgccaatccatgagcatgggagatctttccatcttctcaaatcttctttaatttctttcttcagagacttgaagttcttgtcatacagatctttcacttccttagttagagtcacgctaaggtattttatattatttgtgactattgagaagggtgttgtttccctaatttctttctcagcctgtttatcctttgtgtacagaaaagccattgacttgtgttagttaatctcatatccagctacttcactgaagcggtttatcaggtttaggagttctctggtgtaatttttagggtcactcatatatactatcatatcatctgcaaaaagtgacattttgacttcttcctttccaatttgtatccccttgatctccttttgttgtcgaattgctctggcaaggacatcaagtactatattgaataggtagggagaaaatcggcacccttgtctagtccctgattttagtaggattgcttcaagtttctcaccatttactttgatgttggctactggtttgctgttgaatgctttttatcatgtttaggtatgggccttgaattcctgatctttccaagacttttatcatgaaagggtgttggattttgtcaaatgctttctccagcctttcattctgaggttgtgtctgtctttttccctgagatgggtttcctgtaagcagcaaaatgttgggtcctgtttgtgtagcccgtctgttattctatgtctttttattggggagttgagtccattgatattaagatatattaaggaaaagtaattgttgcttcctattatttttgtttttaaagttggcattctgttcttgtggctgtcttcttttaggtttgttgaaggattcctttcttgctttttctaggtcgtggtttccatccttgtattcattttttttctgttattatcctttgaaggactggattcatggatagataatgtgtgaatttggttttgtcttggaatacttttgtttctccatctacggtaattgagagtttggctgggtatagtagcctgggctggcaattgtgttgtcttagtgtctatataatgtctgtccaggatcttctggctttcatagtctgtggtgaaaaatctggtgtaattctgataggcttgcctttatatgttacttgaatttttcacttactgcttttaatattctttctttatttagtgcatttgttgttctgattattatgtgtcgggaggaatttcttttctggtccagtctatttggagttctgtaggcttcttgtatgttcacgggcatctctttctttaggtttgggaagttttcttctataattttgttgaagatatttgctggcccttcaagttgaaaatgttcattctcatctactcctattattcgtatggttggtcttctcattgtgtcctggatttcctggatgttttgagttaggatctttttgcattttccattttctttgattgttgtgcagatgttctctatggaatcttctgcacctgatattctctcttccatctcttgtagtctgttgctgatgctcgcatctatggttccagatttctttcctagggtttctatctccagtgttgccccactttgggttttctgtatagtgtctacttccctttttagatctagtatggttttgttcatttccatcacctgtttgggtgtgttttcctgtttttctttaaagacttgcaactctttagcagagttctcctgtatttaagtgagttattaaagtccttcttgatgtccagtaccataattgtgagatatgcctttaaatccaagtctaggtttttgggtgtgttggggtgccctggactggctgagttgggagtgctgcattctgatgatggtgagtggtcttggtttctgctagtaagattcttacatctgcctttcgccatctggtaatctctggagtcagttgttaaagttgtctctggttaaagcttgttcctctcgtgattctgttattctcttccagcagacctgggagactagctctttcctgagtttcagtggtcagagcactctctgcaggcaggatttcctctttcagggaaggtgcacagatatctggtgttcagatttgcctcctggcagaagatgatggcctgaaacaggacctgtcccagaagctgttagcttctgtagtcaacactgtcacctgtgcagactagtctcggtggagtccgggaaccaagatgtctcctgcagatgctctggcattcccttctgggccgggtgatcacctctcctctggcagggaaggtgccctggtgtctggaacccgaaaagggggctgcctcagaagctctgtggctactgcctgtcccagaagctgttagcttctgtagtccacactctcacctgtgcagactagtcttggtggagtctgggaaccaagatgtctcccgcagatgctccagccattctcctctttctgttgcttattttgacctatgaaatcctggacatatagttctagtgttgcttgtaatctcttttctaagccaaggaattttttttatctagggcacaatcttttgagaagacatattaaatcaagagaataaatattgcaagaccaataaatgataaggtatctattttctttaaatccatcgctgtcaaaccattcaaaatatcctcacataaagccaaaaagatatttattgtgtttcccatcttagttgagttcaagtcaatattttggtgccattttgttgcagtaaatctctaacacaaatatgcctgggcaatgaaaacacaactcagttaatatgaatacagattgttcagatctaccactacactaccatcttcttcatctaagagaccccttagaacttgcagtttctccaggccttgtgcttctgcgctgcttttcttcttcttcctcttctacattgcttctctcataaacctacttctttttttccctccttctgttccatcttcccttttatctgcccaatcattagctctcctttattttacaaattaaggtgtgaagccggtttctaggaaatcacctgagtgctgacttgttccttgttcagagccacgcacaggagaacagaattaacatcaaatataattatccccagggctatccacaacacgtgcatcctataagatcaccacggactaatgctggtcttcaattacaacataaacaacaaaaaccccacatatatgtggaaacaaatcgaactatacaaagaatcaatgaaaccaggagcttgttctttgagaaaaatcaacaagatagataaacccttagccagactaaccagagggcacagagacagtatccaaattaataaagtcagaaatgaaaggaagacataacaatgaaatatatcttaaaataattaatctgtttgtagactattagcagttgaaaatattaaaatcatgttctacaaacgtggaattattattgataattttctcactgtgcttgaaattagcattttcttaatgtttaacttcaaagagtttttgctattttgaaatattaaacatatacttactgataaaataatttccctcctaacaacactgataatctttttttaagtaaactgattattagacaatgtacacagatatataatgtgttttaaatactctcccactgtcaggtggtatcatatagggcctttgaatatatttttaaatgtattatttgtaatattttatggtctctcctatgcttatttctgaaagaatattttgtatgttttgaaacaatttagtatttaacattagatataggatcctcagttatggatagtattaaatattcattaatgatatttttaaggtataaaaggatatgaatataaaagtttaacaaattttatgtattatttgattctaaaaatactcaatattattaatatgtttgatgtttaaaatgcatttaaataataaaaacatttaaaaaaataaaatcaagaaatgaggttctaagcagaggtcaaggaaaatgaggaatagaaaaatagtaaaaatcaatatgtccatttattcaaggaaagctcctacatagacattgcaccagattagcaaatattatggtcctcatattagtttaagttaggagactatgcttatgttatctatttacattctaaggagcctagacatttgtgaatggattacattataagaggaggatgtctacttaagtaggcatgaacgcctgtgcattgcaccctatgagttccatcagcattccatgattggagtatgaagaacagcattatagacattacccagaaccttagtggttctagaatgccaagataaaacaatctaaccttctggatagtagggataaatgttcctatatcatcagaattcactggtgccctgaggatgttaccctgctaactgacaattcacaggacatcacatggattctgataagttgcagaaaagaggagatgcattcaattggtcctcctccttctaagctgcaatattaggtgcatccaatttgtgaacttcaatttagattacaatagacatgaataatctgaattcatgtagtacatatttttgttttaatatgagttaccattgttcagaaaattaaatacacatgatcacatattcctacatagtgctgttagtttttcacatctctgggacaatattccaaatatctccttcattagtgaaaatatcaactactgtaaagcttagctaacatgcctttgcaggaataagaacatcctggattgaaagctacacagggagatgtaaaactttctaagcacacacattctccatccattaggatcatggtccatgagatttttctctctctcttcttcccattaaatgcatgtacatgcaggttgggaaacagattgtgttgcagaatacatttgcttgatttccacttccttctcaatgcaaatatttttgaagtgttaattttgctgtgagtaccacagtggttcttgctctttctgttgactcctgtctgtgaatgttccaggaattcacacatggacacacgtggggctgcatctgagctccagactcactgttgtccttctgtcctcagctgctctggcccaggcacagcctcgtgaattcaacaaagaccctgatctctcttgtttacacctcattacaaatgggaactgttagaggtggacccaactgcatttccatgaggaaagcacatgagtttgagagggtcgttgatgataaggtagaaacaactttaattcataggctgagatatcagtcatcacctccagataaacaagagccatttcttcctgcatctgagccctgtaagcacactagctttaggaatatgttactgctgaagtcagattgggcaacttcatagtatacaatagaaaatctacctgcagatgagttcagaaccagcagggggcacaatggggccaagaatccctagcagagagatgtggtgtgtgtgcaggggactctgcatcctctgtggtttcctttcttaacttacatgtacctgtagtgattgacatgtaacgtttccacgctcaaacactgtgaagatactttgctaaacacttcaaagatttatgttttcttgatgtgtgcatgtgtgtattcttttttgtttttagacacagggtttctctgtgtagtcctggctgccctggaactcactctgtagaccaggctggcctcgaactcagaaatctgcctgcttctgcctcccaagtgctgaagttaaagacatgtgccaccattgcctggccatgtgtgtattcttgatgcactcttctgttgacagatacacagtttatttccataatttatttattgtgatggtgctgcaataatcacttatgtacaaatgtttctgaagtatatttagttttggtcatttgggtgattatttttttctttctagtatatagcattttggaaaggtagatattaattgtatgtatgggaaggaggctgtaaattctaataacttagctgcttttgaaatttgtcctcaattctatcatccttgtaaccaccttaaatccatctattagccttgtcacaagtgagccactgtctcaggctgcaaatctttttatagattaggtcgtgatgttacatccacagcctctgcacaatgctcaggggtgggatatgggatgaattccctcagacagcattaggacttggatctcagcagactgattcttgacccaaatgtctcttcttctctagcaggagtaagtccttatctaagatgtactctgctcatgaatatgcaaatcaattgagtctatggtggtaaatatagggatgtctacacccctcaaaaacttaagatcactgtcgtcttcacagtcacaggagtacacaggacatcaccatgtgttggagctgtatcatcctcttcctgttagcaacagctgcacgtaaggggcttacagtagcaggcttgaggtctggccatacactcatgtgacaatgacatccactctgtccttcccttcacaggtgtgcactcccaggtccagctgcagcagtctggggctgagctggtgaggcctggggcctcagtgaagatttcctgcaaggcttttggctacaccttcacaaaccatcatataaactgggtgaagcagaggcctggacagggcctggactggattggatatattaatccttataatgattatactagctacagaaccagaagttcaagggcaaggccacattgactgtagacaaatcctccagcacagcctatatggagcttagcagcctgacatctgaggactctgcagtctattactgtgcaagacacagtgctacaaacacatcctgagtgtgtcagaaaccctggaggagaagcaagcagagctggaatggagatgacagaaagattatcatttagacttgctcagaaagagaaattttgaatgcccatttattgcctcttccttacagtactatagtgcctgtttttgttgacattttcaaactaatttccaaagtcactaccacaatttacaatcacataaaaagcaagcaaggataacattattttctgtgcttacttgccatttatattcttgcttattctcatctcactgaggtcatattgggacattaaatttctggggttactttttattaaaaatttttcattattcattcactttacatccttctagtcttcctctcacacatgccctatccctttctcctctgagaggatggagccctccctaccctcgtatccccttacccaggcacatcaagtgtctgcagtactaggaatattctctgtcaatgctgccagacaaggcagacaagttaggggatcaggattcacaggaaggcaacagcttgagggacagcccccactgaagttattggtggattcacatgaagactgagttgcacatctgctacatatattcaggggtcctatttacagctcaagtagactcttgttggtggtttagtctcttagaaccccaagtgtccaggttagttgactctgtgggtcttcctttggagttcctatcccctccagatccctcagttcttctcccaactcttccataagacacccgtaggtccatccaatgtttggttttgggtttttctgcatctgcttcagtcagctgctgggtggagcatctctgaggataattatgagaagctcttatgtgcaagcataacaggatatcattattagtgtcagggactggtgcttggccatgggatgggtctcaagtttggtcagttatttggccattcccacagtctctgataatctttgtccctgcatttcttgtagacaggaaaaatattgggttgaaagttttgtgggtgggttggcgtctctattgctccactgggcttctttctggatataggagtttgcctcttcaggttccatattcccaaagtagtgtgtcacactaaggtcactcccatacagagggacactcattctcttgccacgtctctgtccaccttcattggacctgaggttcctgaatcatacagaactgcatgtgtgcaaccacacagaacaaggctatctatcagaggcctaccataccaggaccatcaaggttcaccttactcccaatactgactacaaaaagaacatcaaggaccaatgcagtctatatggataaacacacttgaaagaacacaaacaagattgagggcaacatgacacctccaaagcatacctaaccgagtacagcatgccctggatatcctaacacaatcaaaacacaagaaagttaccttaaatccagtcttataaaggtgatgaaggcctttaaataggaaatgaattaatccttaggataatacaggacaatacattcgaacagatagaggtctttaggaggaaagaaataaatccctcaaagacatacatgaaaatacaattaaacaggtgaaagtaataactacaatggtgtaagacctaaaaatggaaatagaagcaataaagtaacacaaacttagaatcttgaaggtggaaaacctagagaacaggaatactagatgcaaggatgatatcttctaggtccatccatttgcttgcacaatttatcatgtccttgcttttaatagttgaacagtatttcattgtttaaatgaaccacatgttctgtctccattctctggatgagggggtgagcaagtttttccacattctggctattacaaatagagctgctatgaacctagtagaaaacatatcctgtgtatggtggagagttttggagtatatcaccaagagtgttatagctgggtcttcatgtagaactattcctaattttctgagaaatcccaagtcagatttctagaatggttgttcaagtgttcactccaaccatcaatggaggactgttttccttgccagcatgtgctgtattttgagtttttgatcctagccagttttatcctgcatttcacacttagatatggactatggtacaggacagagagaaaccaaccttctactcaccaggatattctacctgctaccaatttatttatttatttatttatttatttatttatttatttatttatttatattagagaacaacaccatgcagtttagaagaagtactaagacgtcagtgatgttatactgtgcctaaccttgcattgtacaatctcagctttcaggtaagacagtgcatgactcttatgcagtgccaactgttttctgattgtatttatggtctattgcctaggaatgacctcctctcaaataaacatggtcaaaagcccatggcctgagatgacagagcccctagtagaccctagttgtatttctgaagtttagatatcataatgacttataaatacttatgtttatacaatagattagagctgctctcagccatgaccaaggagcttctgtgttcaatgaataatgattgatgcagacattcgtgagtggtcaaagtggtgagaatgattagagagtcctcagccacacaagcgttaatgatatgaactttccaatatattaactgtattaatgaataaatgcagacatcatatgagatctcattagtagttcttaggtattgcatttttatatacaattatgcatatcagtacattatagtgtataaaggaaattgtctagcataatagagaaaaataggacagtcaagaaacaaaagagtagaaattatgggtgaaatatgcagtgtgaaatatttacatgaaaattttaaccatatgtaaaattgttatttttgtttttcagaatgagtttgctcattctttgacatttttattcctgtgtgaaatatatcaggatcatatgtatcccattctgatggtctgacttccactgggaatttccaatatatctcttccaactaactgaccagtttctttttttcttattttctctctttctcgttttgttttgctttgttttgtttttcaagacagggtttctctgtgtagctctggctgtcctggaactcactttgtagatcaggctggcttcgagctcataaatccacttgcctctgcctcctgagtgctgggattaaaggagtggctaccacgcccggctagtttttttttttcttataagaacaacatttactggatggtcacttacatattcagaggttcagtcaattattatcaaggcagaagcatggcagtggtccagtagtcatggcactggggaaggagctgagagatctacatcttgctccaaagggaaagaggaatagtctgacttccatgtgtttcagaggagggtttcatttcccacccccacagtgacacacttcctccaacacggccacacctcctaatattgccactcttggatcaagcatattcacaccacaaaggaaagtttagagataaacattaagaaaattaatgaagtcattttatcttatatgctcaacatgactagtacttaaaaccataattttacatgtacaatatttcatggcataacatattttttatatttttattagatattttctttatttatatttcaaatgtgataccctttcccaattcccctccaaaaatcccctatgccttcccctcatagccagctcccaaacccacccactcctgctttctggtcctggcattcccctatactggggcataaaaccttcacaggaccaagtgcctcttctccattgatggccaattaggccatcctctgctacatatgcagctagagccatgagttccaccatgtgttttctttgattggtggtttagttccagggagctctgggggtattggttagttcatattgttcctcctatggggctgcaaaccctttcagccccttgggtattttttctagctccttcattggggaccctgtgctccatccaatggatgagtgagcctccacttttgtatttgtcaggaactggcagagtctctcaggagacaattatatcaggctcctgtcagcaaaatctcgttggcatctgcaatagtgtctgggtttggtggttgtttatgggatggatttctgggtggggcagtctctggattgtcattcctttagtctctgcttccacctttgtctttgtaactccatccatgggtattttgttcccccttcaaagaaggatcaaaatatccacactttagtcttccttcttcttgagtctcatgtgtttttcaaattgtatcttgggtattctgagcttctaggctaatatccacttatcagtgagtgattatcatgtctgttcttttgtgattgagttacctcacttagcatgatatcctccaggtctatccatttgtctaagaatttcataaagtcattgtctttaatagctgcatcgtactcaattgtgtaaatgcaccacattttctttatccattcctctgttgagggacacttggtttttcccagcttctggttattataaataaggctgctatgaacatagtggaacatgtgtccttagtacatgttggaacatcttctgggtatatgcccaggagtggtattgctggatcttctggtggtactatgtccaaatttttggggaaccatcaaactgatttcctgagtggttgtacaagcttgcaatcccacaccagcaatagtggaatgttcatctttgtccaagtccttgccagcatctgctgtcacctgagtttttgatcttagccattcttactggtgtgaggtggaatcttggggttgttttgatttgcatttccctgatgtttaagggttttgaacatttttaggtgcttattagacatttggtattcctcagtttagaaatctttgtttagctctgtaccacatttttgaatagggttatttggttttctggagtctaacttcttgagttctttgtacatattggatattagccctctatcagatttagaattagtaaggatctttccccaaactgttggtggttcttttgtcttattgacagtgtactttgccttagagaagctttgcaattttatgaggtcccatttgtcaattcttgatcttatagtacaagccattggtcttttgttcaggaatttttcccatgtgtccatatgttcaaggcatttccccactttctccactacaagttttagtgtctctggttttatgtggaggtccttgatccacttagatttgagctttgtacaaggagataagaatggatagattcacattcttctacatgctctctgccagttgagctagcaccatttgttgaaaatgctgtcttttttttcccccactggatggtttttagctcttttggccaagatcaagtgaccattggtgtgtgggttcatttcttggtcttcaattctagttcactgacttacctgtttgtcactgtacaaggaccatgcagcttttttcacaattgctctgtagtacagcttgaggtctgggatggtgattctaccagagagattcttttactgttgtgaataatttttgctatcataggatatttttttatttcagatgaatttacaaattgctctttctaactctgtgaacaattgagttggaattttgattgtgattgctttgaatactcaagatataatttacaaaacacatgaaacttaacaaggactactaaagtgcagatacttcgatccttcttagaagggggaacaaaatacccatagatggagttacagagacaaagttcggagcagagactataggaacgaccatccagaggtccacctggggatccatcatgtaaacaaccacccaaaacagacactattgtggatgccaagaagaacttgctgacaggagtctgatatagctgtctcttgagaggctctgccagggcctcagaaagtggaggctcacagccatccattggatggagcacagggtccccaatgaaggagctagagaaagtactcaaggagctgaaggggtttgcagccccataggaggaacaacaatatgaactaaccagtacccccagagctccctgggactaaaccaccaatcaaagaaaacacatggagggacttgaagctcttgctgcatttatagcagaggatggcctagatggtcatcaatgggaggagaggtcaatggtcctgggaaggttccatgccccagtataggggaatgccagggccaggaagcaggagtgggtgggctggggatcagggagggggagatgatagggcattttcagtggggaaactaggaaagaggataacatttaaaatataaataaagaaaatatctaattaaaaaggattacctatgtgcatgggagctcatgagcagcaggggtcactctaaggccaataatccacatagagcgatgagctgtgtgtgaacaggactctgtatcctctgtggtttcctttcttaagtgtattaactgatctgtccagctgtgattgacatgtgatgtctccatgctcaagcccagtaaagattctctgttaaataccttacagacttatgtttacttgtttttatttgcttttcatatttttttaaaaagtcatacaatgtattctaataactcattctcccatctccaatttattctaagtttttcttaactcatccaaccacacactttttaattctgataaagcacccccccccccaaaaaaaaacccaaccaaccaaaaaaaaaaaaagccaaggaatttaaaaggggattgaaagcaaataaaaactaaacaaaaaagtaaaaactacacacacacacacacacacacacacacacacacacacacacacacactcacacacacacacacacaccacacacacacacacccatgcacgaacacacacacacacacacacacacacacacacacacacacacacacacacacatggaatccagtaaaaccacaactctttacccatgatacacaggaaaatataagtcaaacaaacagaatggaagaaggtggtattataaaaatgtctgcacaaataccattaagttcattttcttgttggctaccaactgctaagcctgtctcccttgattaattgtgcttatcatcccctatgaactccattggaggacactaatttttccttctgtctccaggaattgaagtgttgcagaactctcagtagctttatttacctgcacaatacagcctctaatccaaccagtgaaaattaccacatgagagacttccaaatgaaagaacaggtaaagttgtctactggcaagcttagtaatatcatgtaaatgccttagaatttaatgacatatgtcatcctctgaggttaataaatccattttggtgcatatataccctgaactcaccactaacataatacaacaattaaaaaattccaacatggatgcagaggaatccctgagggacatttgttgatttgtgagcacaatataattattttttgggggggaaatgtctgaatgttaactctttaccagtgataatctattctattaatgtgtacataggtagcactaattaaaatcactgtgttatcaggtaatgaaacagaggaagtaggatgctgggaaacagacttttggaaggtcccaagggaaaccacagggacctagtggtgatagattatggtgagagtcctgagagtggtcatagattatagcatatttcatatgcaattgaaaatttcaaagaatgaaaatccttatgaaatatagaaataacaactttacttatgtacatatacttcatagtacaatttttacactgtgcatatttctcctgtaacatctggttcctcctattttcctttattctcctagacaatttcactgatacaatctcatgtttttgtataaatagttgtatataactattaaatacataagctgttaatgagtcttcattaatgtctgtgatttttttattgtcttaattaatactattatctctaattgcatccacattttcaaaagcaatgtaaatttcttactcatttctgttcaaaaacttctgttgttgtatcattaccatgccttagtgataaaatcctttcttgacacatctatagctattgctataatttagttattgatgatcctcctgcaataatcattgataggtaaatattttaagcacttttacttttagtcattttagtgagatttgaagtagtatataacctgttggaaaggcaaatattaattccatatatgtgaaagaagacgctaaaactaaaaacattagccacttttagatatcttctccttcttcttcttcttcttcttcttcttcttcttcttcttcttcttcttcttcttcttcttcttcttcttcttcttttcttcttcttcttctccttctccttctccttctccttctccttctcctcttcctcctccttccttccttccttccttccttccttccttccttccttccttccttccttccttccttccttccttccttccttccttccttccttccttccttccttccttccttcctttctttctttctttctttctttctttctttctttctttctttctttctttctttctttctttctttctttctttctttctttcttctcctcctccttctttttccttctccttccccttcaccttccccttccttcctctttcccttccccttctccttctcctcaatctacaatctgttaacatattaacatgtcccagagtagagcaacagactcaggtcaaacatctactgagaaatttgcccatgtagttaacatctacagcatctgtctaggggttacaaaaagtctatgggatacaattcctcagaaaggaataggatttggacctgagcatactgctgcctaacacatgaaatggcagttcttctccagctggactaggtccttaactaagaaatgcactgctcatgaatatgcaaattacccaagtctatggcagtaaatacagagatgtccacaccctgaagacaacctatgaacaatgttctctccacagtccctgaagacactgattctaggaccgaagttcctattccgaagttcctattctctagaaagtataggaacttctcgcgcgtctggcctccgaggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagagaagttcctattccgaagttcctattctctagaaagtataggaacttcctagggtttcaccggttaaatggcatgtcccctgttagtggttcatgcaagcagaagctgtatcctgtttgacaaagattcagcatgaaaggtcctgctacctaaaaaaaaatagacagatgagatttaattaacctaaataatttttttcacaacaacagagtgaatacgcaatttacagaatgacagaaaacttttgcacactttgcctgtgacagggaactaatatgaagaatttgcaaggaactcaaacaactctacaacaacaacagcaacaagaaccaaataactccgttaaaatgagcaaaggacatgagtagacattttcaaaagaacacatagaaatggataataaatatataaacaatactcaacatcactaaccatcagggaaatgcaaattaaaaccacaataagatatcatcttccaccagtcacaatgactattactaaaaactcaaataatatcagatgttgctgaggatgggaaatgaaggcaactcttagacattgttgatgaggatgtagatgagtacaacctctgtggaaaatggtatggagatttcccagaaaactagaaatagaactgtcatttggtccagcaatcccactactgggtaactacccaaaggaaaataaactattatttcaaaaagatacccaccttctatgcttaccataaaactactctcaatagcacatatgtcaaactgagtgtctgccaaccgatgattttataaaagaatatagcatgtatgcacaattcaatactagtcagccacaataaggaatgaaactgtgtcttttgcagcaagatgcatagaagtgggggacaatataattagtgaactaactcacaaacagaatgtcacatgtcacacattattacttgtaagtgggaggtaaacagcgtgtacacaaggatttgtagagagaaattacacacattggagacttacaaggatgggcgggcagaaggtgggagcatgatgagtcattacataacaggcacaatataaaataattaagaattgaccaatgatcttaaaattaaaatgtagaatatgatcaataaatgaacttgatattagttgacctcattaaatttaaaaactttttctactcaaatgactgtaagaaaatgaatgcccggttacagatgagaaactgtttgcgagtcaaataaccaccaatgtaactataataagaaacttcagaactcaactgtgaataaaaaagaaacaactgatggataaattaggcaagggtttctacagacatttcgtcaaagaagatgtgcagatgacactgaagcatataaacaggatctcaacaggattttccgttagagaaattcaaatcaagcccgcaaagagacaccactgtacactttttaaaatggctgaaattaagaagaaatacagataacatcaatgctggtgagcataccaggttgctagaggctaaaacattgctaacaggaatgcaaaatgaaacagatactcaggaaaataatttttagttttctctaaaatcaaacatacccttaacacctgaatatttgcatcagagaaaaacaatcttacattcacgcataacttctattcaaatattcaagatatcgtgtgtatgtgtgttagaaagtaaaaataacataaatgtctcaaaatttgaataggtgaagaactaggaagcatctataaattgaataccaccagcaataaaaaaataacaagtgaccgatacataaactattacaggtgaactccagacattgtgctaagtgagagaagccagtctcaaagatcaaagggacacagctgtaagcaccacggtcatcctcaggtgtcagtggtttgggctggactttctgtgtctctttcctgaccagacccagatattgagctccaccacttgcagatggaaaatcctattttcaaccatgcagtgaggtttgaactgcttcacagactgaacgaaacaaacacgggctcctttgaacagcgtccggcatttgttccaaccacaagagaacgtccctcagctctcccacctcctcggttctctcctgcaagccagcagccctgcagtttagcctgcatctcccgtgcatccacccatctccctccaagcaccttcccccacaccctccactgtttctgagagcacaggcaggctttgaacttttccgcattctgttgttattgaagttaggatgtttaggaccaacttaaggatcatattttatgactgaattccagtgccccttctctcctgggacagagtgcataaccaagtttctgcaggtggagacgaagttgagcttttttcttcctcagcctaggagatgagcgctaattggagggttggcagaagcttcccaccatcccagcactttggttctggtggggcggaatcggtgccatagggcagagctagaaaccgcggactgaatgttcccagtggcactggacccagggcagagcctccatccacgagtggggctctatggaagaagtgagtctctggctctcagtagctctcgtccagcactgaacctcagcatcatgtgctgtgtgcagggtcagagggccaacgtactggcccctgggaaagcgtttcctctggtgggagttggtagaaggtgtcctgtcttcttggctgcatctgtccgcagtggagtttacatcatgctgagctgggatgtggaaggaaggaagagcatcttagatcaaatatgatgactggccttactgagttttctagattttcctgaataaatgtttcttcactcactgtgtgctgttagagtctttccaaacctgtaatttcccaaaataattttcactggtctcatgagggcatggattcattgagcccctcatgctgtcaaagagaaatagaactgtttttttttttcacttcatagcgaacatccatgggttatcaaataatgggctggcttttcttccaacactttacagacaccatcaattttcttcttgcttataaggttttaaccagaagaatgctgtcatggtcttttctgttcttttggaaggaatgccccctctactcacctccacttgtctgcctgtatttctatttgtctttggttttcaacaattttaataagatttacctaaatgtgtgtggggggagcatggggtgttattctgctgttctgtgttctctgagatgcatggattcaccatttactctgtctccatttttgtgaaaacaattagaaaaaaagtcagtatgagcccagaaacaagcctccctgaagtgggcacaggaccacctgggggcgctcaggacccactgaacacaagagccagccccagggcaggtgcagatgcgggttaagttctggtttcctgtcaaccctgtggcttcctctccataaaacagtttcctttgtggcatatctctggattccttatcctgttcttcctgtgaagtctctgaagaagaaacatttgtcgtaacaagagaaaaactttctcacatgcaccaaaggcagagtcacctacagtcacttactcctgtttctcaatgtcaataagttaccaatgcttctgaagttaatcagctaaatctataaaaggtgcggtgtttaactcagcattacagcccagctcaacagaactccaaaggtcagccagcagcagccaggaaaaagtgcatgctgggcattggggcagagggagttaccatccagtgcaagagaagaaagcccccgtggtggtcattgtcaggactccaatcccacagttccaattgtaggtgatgccaggcaaaggaagagagaccccaccaatggttagtgtggatgtcgagtttgatgtttccacactcacactccaggtgaatatgaaaagatttattagctctatttctgaggtgtctgctgagagcagcacagtcctctcaagaaattacagattggaatttcctcagtagagcaggaaaggaggctggctcagggctttataatgatttggtggtggggtcggcgggggggggggggcgtttctactcaggagaaggagcttgtgtgatttaaacctcacactgacatcacatgagggagcttccatgatttcttactagatttcccatgtgtgggggacaaggatgagggagaataaaccttaattcatcagcatcaaggcaccaaaaataggacctgacactttattctccctagcagcttaagaaaatgagtgaaaaagagagataagagtccacccatgtgctgaaaagcatagctcttggtaaagacgagaaaaaggcactcctacgaagaaggggttgggcagaagctttatgctgaagggtttggctaaagagacataatcaacaggttacaggaggggctactgatgttcatggaggtggtcctcacacatgcatactgaacaaacatgtctgtaacgtatgacccctgttcacttaccagtggagacttagcatttaaattcattccagtcaggccctatgtgcaaacagcagaagcagagacacaaaggtactcagggtgcagcctctgtgaacggccagagccaggccatggtcagcggtctcggattaggagaaagttcctgatatcactgtagtgttcaatcaaagctggggttatggtttgtggaacaggggtcagttcatcagggggtgggctgcaattgtcttcatagtgcttgtctcagtgccggtgcttactgagccactagagaaaaaggtttaattgagcttctttaaaatcaacattttgaattatttatcagacgtttcaaatatgtcatgttgtttagattctattgctggagagttaaggtgatatttggggttttgtaactctgttttttcatacttcctgaattgcttatctgtttgcttttcattagctaaactatcgcttcttcttattttttaattcattctgattttgatgaatatttaattccctttagaatgtgaatataatgtacattgtgtgggtattttgattttggttcttggtttacttagtggcaaagactctgtaagagttccttgtctatagatagccattatttagtggctttctgaaatggtggttttagtaccaaagtactggacttgtgagtaggctcactgccccctgcaggtcctagatagtggaggcctcaggaactgtttctcatttggaatgcctttgtttcagcagattttgtgttgggttgttaagttcaccctccacattagtagatgtccttacagattagagctgactctggtagaagcagttgagtgcatgcttgatatctgtgcacagggagaagctctctgttgcctcaggcgatggactggtctatgaaatgcacagtgacctgagttccctgctcagcccctgagaggtggaccaagctggacacacatgagccaccgagcctggcaagcaaaagcgccagccttgatggaaatggcgagctgagcggcatctactcagtgtggtttcttttgttattaagagctttagtgtggtggctgtttcaaattcccgttgtagtagtaatatactgggtatgtgagcaggcccgtggtcttttgcggggttggaatcaccgaagtaatgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttactggtgattaaagtgggaaacttggcgtgttccagatcttagagaaaagatttttagttatttctcattcaacctgatactacctgaaagtctctcgaatgtaacttttattttgtcgagatgggttctttctatacccattttttatgttttttttgtgaaaggatgttgtttcatcaaatgcgttttcagcatcaattgaaaaaagttatatgtggattaaagatcaaaatgtaaaacctaacactataaaacctctggataataacataggaaacagaatttaggaggtaagaactgacaaaggttttataatgaaaatgctagaagtagttgcaacaaaattgaaaattgacaaatgggacctaagtaaattaaagaacttctgtacagcaaaagacactatcgacagagtaaacaggcaacctacagaatgggaaataaaatatttgcagcctatacatctgacaaaggtccgacacttagtatatacatggaaatttaacaaacatacaagaaataaaaagtgaccaaaggacatgaaaagacacttcaaaaaagacctacatgtggccaacaagcataggaaaaaatgctgaatatcactatcattagagaaatacatatcaaaacctcaatgaggtaccgtctcacatcagtcaggatggctaatcttaaaaaaaaaataacagatttttaaggttacagaaaaaaggggaaatttatacacttttggcgggaatataaatgagttcaaccattgtggaaagcagtgtggtgatccctccaataacctaaaacagaagtttcatttgacccaacaatcctacaactggacatatacctaaaggaatataaacatgtaggttcactgcagcactatccacaatagcatagacatggaatttacctaaatccccatcactggcagaatgatagagaaaaatgtggtacatacaaccatggaatactatgcagctaaggaaagaatgaaactatgtcctttgtaggaacatgatggaactggcagtcaatactcttagaaaactaattcaggaacagaaaaccagatattatatattctcccttatttgttggagataaataaaagcaaatattcttccagggcctgagtcttccttattcaacaagtcattctaaattaagtgttcagcaagttgctgatactcatctaaatattctatttcatctgggccacttacatcactcaaaaagcaatgagagctatatttctaaggggggttctaggataataaatacctgaatagtgagaatatgaaggatatggaaactgggccacttatatcactcaaaaaggaatgagagctatatttataaggggggttctaggataataaatacctgaatagtgagaatatgaaggatatggaaactgggccacttatatcactcaaaaagcaatgaaagctatatttacaaggggggttctaggataataaatatctgaatagtgagaatatgaaggatatggatggtttttttttaactcaatgggcacataactgtgggagatactatattcctatgaagaaggtattcagacttcagagataagtaatgtttcctacattgtgcttgtgacttggaagcagtggattgaagagtgtgataagtgcccagaccaagcagaacagaaatcagcatgtaaagatgatgatctatggatatgatctaaaaccatgtaaatacttcaaataattctatttaatgcagtttgaaataaaacacaaacttattcaaaatacaaattacttggtaattattttgggagctatgagttcaccaagaaactcaaattcctatttctatttcaacccctgattcctactgtcaatgggagggaagtctcagaaccaatcacacatcagacggcaaatctgtcaaccaagagtctttccactgaaggacctgggaggtcaggaccctcaggaaagtgctggggaccctgtcttgggagtgcccagcagatctcagaactctccatgggtcctgctggacactcatgtagggtaacgagtggccaccttttcagtgttaccagtgagctctgagtgttcctaatgggaccaggatgggtctaggtgcctgctcaatgtcagagacagcaatggtcccacaaaaaacccaggtaatctttaggccaataaaatgtgggttcacagtgaggagtgcatcctggggttggggtttgttctgcagcgggaagagcgctgtgcacagaaagcttagaaatggggcaagagatgcttttcctcaggcaggatttagggcttggtctctcagcatcccacacttgtacagctgatgtggcatctgtgttttctttctcatcctagatcaggctttgagctgtgaaataccctgcctcatgcatatgcaaataacctgaggtcttctgagataaatatagatatattggtgccctgagagcatcacataacaaccacattcctcctctgaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagagacacagtgtgaaaacccacatcctgagagtgacaaaaaccctgagggagaaggcagctgtgccgggctgaggagatgacaggggttattaggtttaaggctgtttacaaaatgggttatatatttgagaaaaaaagaacagtagaaacaagtacatactctaattttaagataaatattccattcaagagtcgtaatataagccaaattcacagagtggaaaaggcgcgatcgcggagcaggggatccttagatattggttggggttatctcaccttaggtctgaatatggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccacccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggccagggtctagtgcaggtgcccaggacaagaaagattgtgaatgcaggaatgactgggccacacccctcccgtgcacgccccctcttgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactctacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactgtctcctggcccctgctggaggccgcgccagagaggggagcagccgccccgaacctaggtcctgctcagctcacacgacccccagcacccagagcacaacggagtccccattgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgcccctgtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccccggtcctcactaggcctcagtcccggctgcgggaatgcagccaccacaggcacaccaggcagcccagacccagccagcctgcagtgcccaagcccacattctggagcagagcaggctgtgtctgggagagtctgggctccccaccgcccccccgcacaccccacccacccctgtccaggccctatgcaggagggtcagagccccccatggggtatggacttagggtctcactcacgtggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgttcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccccgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatacccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcacaacaggtgtttctcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaacagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacccgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaaccttctgccacagccctccctgtggggcaccgccgcgtgccatgttaggattttgactgaggacacagcaccatgggtatggtggctaccgcagcagtgcagcccgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggctggcccacattaccatttgctgccatccggccaacagtcccagaagcccctccctcaaggctgggccacatgtgtggaccctgagagccccccatgtctgagtaggggcaccaggaaggtggggctggccctgtgcactgtccctgcccctgtggtccctggcctgcctggccctgacacctgggcctctcctgggtcatttccaagacagaagacattcccaggacagctggagctgggagtccatcatcctgcctggccgtcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccaccagctgcaccagaccccgtcatgacagatgccccgattccaacagccaattcctggggccaggaatcgctgtagacaccagcctccttccaacacctcctgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaataccactcatggagcccccagccccaggtacagctgtagagagagtctctgaggcccctaagaagtagccatgcccagttctgccgggaccctcggccaggctgacaggagtggacgctggagctgggcccatactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccacggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtccttgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcaccccccaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccctctgctctcctctcatcaccccatgggaatccagaatccccaggaagccatcaggaagggctgagggaggaagtggggccactgcaccaccaggcaggaggctctgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcctatctctctcacccacggactcgcccacctcctcttcaccctggccacacgtcgtccacaccatcctaagtcccacctacaccagagccggcacagccagtgcagacagaggctggggtgcaggggggccgactgggcagcttcggggagggaggaatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagccgctcccacacaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgcgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccacggcaccctgccatgtcctgcatttctggaagaacaagggcaggctgaagggggtccaggaccaggagatgggtccgctctacccagagaaggagccaggcaggacacaagccccctccccattgaggctgacctgcccagagggtcctgggcccacccaacacaccggggcggaatgtgtgcaggcctcggtctctgtgggtgttccgctagctggggctcacagtgctcaccccacacctaaaacgagccacagcctccggagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacggtgtccccactggatgggaggacaagggccgggggctccggcgggtcggggcaggggcttgatggcttccttctgccgtggccccattgcccctggctggagttgacccttctgacaagtgtcctcagagagtcagggatcagtggcacctcccaacatcaaccccacgcagcccaggcacaaaccccacatccagggccaactccaggaacagagacaccccaataccctgggggaccccgaccctgatgactcccgtcccatctctgtccctcacttggggcctgctgcggggcgagcacttgggagcaaactcaggcttaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatgcacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgcgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggcacatgtgtggacactgagagccctcatatctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggcctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggtcatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagacagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggagacactgtgcatgtctggtacctaagcagccccccacgtccccagtcctgggggcccctggctcagctgtctgggccctccctgctccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggcaaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcgggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccttggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaacaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgtacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacgattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcccgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccacttcacctgcttctcctggggctctcaaggtcactgttgtctgtactctgccctctgtggggagggttccctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcgccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacccagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggatcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccggcctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgcccagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccccgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcagcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccataccatagggacagagaccagccgctaacatcccgagcccctcactggcggccccagaacaccccgtggaaagagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctgggactgaggggctgggggagcgtctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctcagcagggccttttgctgtttctgctttcctgtgcagagagttccataaactggtattcaagatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggagaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgaccggactcgcagggtttatgcacacttctcggctcggagctctccaggagcacaagagccaggcccgagggtttgtgcccagaccctcggcctctagggacacccgggccatcttagccgatgggctgatgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctcccttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggctctctccttatggttcccccacctggctcctgccgggacccttggggtgtggacagaaaggacgcctgcctaattggcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccgctgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcacccaccgacccgcccacctcctctccaccctggccacacgtcgtccacaccatcctgagtcccacctacaccagagccagcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagattctgtgcaggaccctctcacagtggaatacctccacagcggctcaggccagatacaaaagcccctcagtgagccctccactgcagtgcagggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagacctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcccttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaaaaagacaaagaaatttgtttttttgaataaagacaaatttcatcacacgaagataaagatgcaaagctccagacaggaaggcacggacagcacagtgaagcccggagcgggcgctggggggccaggggcatggcgggggtgccagcgtctctcggttcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgttgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagaaaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagccgagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttttgtttttagacggagttttgctccagcccaggctggagtgcaatggcacaatctcagctcactgcaacttccacctcccgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaagacatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactggcataaaaacagacacagagacaaacagaacaaaatttaaaaacccagaaataaatccacacacctacagcaaattcatttttgacaaagttgccaagaacatactctggggaatagataatgatatctcttcaataaatagtgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttgctacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataagaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccatcctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcctccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtaagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcaggggcacctcccctgcccccagacaccctgtgcccgtcagttcatccccagcagaggccctcaccaggcacacccccatgctcacacctggccccaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttttggggggaaataagggtgctgggtctcctgccaagagagccccggagcagcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcaggtaagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctctagactgagcattgcagactaatcttggatatttgtccctgagggagccggctgagagaagttgggaaataaactgtctagggatctcagagcctttaggacagattatctccacatctttgaaaaactaagaatctgtgtgatggtgttggtggagtccctggatgatgggatagggactttggaggctcatttgagggagatgctaaaacaatcctatggctggagggatagttggggctgtagttggagattttcagtttttagaataaaagtattagctgcggaatatacttcaggaccacctctgtgacagcatttatacagtatccgatgcatagggacaaagagtggagtggggcactttctttagatttgtgaggaatgttccacactagattgtttaaaacttcatttgttggaaggagagctgtcttagtgattgagtcaagggagaaaggcatctagcctcggtctcaaaagggtagttgctgtctagagaggtctggtggagcctgcaaaagtccagctttcaaaggaacacagaagtatgtgtatggaatattagaagatgttgcttttactcttaagttggttcctaggaaaaatagttaaatactgtgactttaaaatgtgagagggttttcaagtactcatttttttaaatgtccaaaattcttgtcaatcagtttgaggtcttgtttgtgtagaactgatattacttaaagtttaaccgaggaatgggagtgaggctctctcataacctattcagaactgacttttaacaataataaattaagtttcaaatatttttaaatgaattgagcaatgttgagttggagtcaagatggccgatcagaaccagaacacctgcagcagctggcaggaagcaggtcatgtggcaaggctatttggggaagggaaaataaaaccactaggtaaacttgtagctgtggtttgaagaagtggttttgaaacactctgtccagccccaccaaaccgaaagtccaggctgagcaaaacaccacctgggtaatttgcatttctaaaataagttgaggattcagccgaaactggagaggtcctcttttaacttattgagttcaaccttttaattttagcttgagtagttctagtttccccaaacttaagtttatcgacttctaaaatgtatttagaattcattttcaaaattaggttatgtaagaaattgaaggactttagtgtctttaatttctaatatatttagaaaacttcttaaaattactctattattcttccctctgattattggtctccattcaattcttttccaatacccgaagcatttacagtgactttgttcatgatcttttttagttgtttgttttgccttactattaagactttgacattctggtcaaaacggcttcacaaatctttttcaagaccactttctgagtattcattttaggagaaagactttttttttaaatgaatgcaattatctagacttatttcagttgaacatgctggttggtggttgagaggacactcagtcagtcagtgacgtgaagggcttctaagccagtccacatgctctgtgtgaactccctctggccctgcttattgttgaatgggccaaaggtctgagaccaggctgctgctgggtaggcctggactttgggtctcccacccagacctgggaatgtatggttgtggcttctgccacccatccacctggctgctcatggaccagccagcctcggtggctttgaaggaacaattccacacaaagactctggacctctccgaaaccaggcaccgcaaatggtaagccagaggcagccacagctgtggctgctgctcttaaagcttgtaaactgtttctgcttaagagggactgagtcttcagtcattgctttagggggagaaagagacatttgtgtgtcttttgagtaccgttgtctgggtcactcacatttaactttccttgaaaaactagtaaaagaaaaatgttgcctgttaaccaataatcatagagctcatggtactttgaggaaatcttagaaagcgtgtatacaattgtctggaattatttcagttaagtgtattagttgaggtactgatgctgtctctacttcagttatacatgtgggtttgaattttgaatctattctggctcttcttaagcagaaaatttagataaaatggatacctcagtggtttttaatggtgggtttaatatagaaggaatttaaattggaagctaatttagaatcagtaaggagggacccaggctaagaaggcaatcctgggattctggaagaaaagatgtttttagtttttatagaaaacactactacattcttgatctacaactcaatgtggtttaatgaatttgaagttgccagtaaatgtacttcctggttgttaaagaatggtatcaaaggacagtgcttagatccgaggtgagtgtgagaggacaggggctggggtatggatacgcagaaggaaggccacagctgtacagaattgagaaagaatagagacctgcagttgaggccagcaggtcggctggactaactctccagccacagtaatgacccagacagagaaagccagactcataaagcttgctgagcaaaattaagggaacaaggttgagagccctagtaagcgaggctctaaaaagcacagctgagctgagatgggtgggcttctctgagtgcttctaaaatgcgctaaactgaggtgattactctgaggtaagcaaagctgggcttgagccaaaatgaagtagactgtaatgaactggaatgagctgggccgctaagctaaactaggctggcttaaccgagatgagccaaactggaatgaacttcattaatctaggttgaatagagctaaactctactgcctacactggactgttctgagctgagatgagctggggtgagctcagctatgctacgctgtgttggggtgagctgatctgaaatgagatactctggagtagctgagatggggtgagatggggtgagctgagctgggctgagctagactgagctgagctagggtgagctgagctgggtgagctgagctaagctggggtgagctgagctgagcttggctgagctagggtgagctgggctgagctggggtgagctgagctgagctggggtaagctgggatgagctggggtgagctgagctgagctggagtgagctgagctgggctgagctggggtgagctgggctgagctgggctgagctgggctgagctggggtgagctgagctggggtgagctgagctgagctggggtgagctgagctgagctggggtgagctggggtgagctgagctggggtgagctgagctgagctggggtgagctgagctggggtgagctgagctgagctggggtgagctgagctgagctgagctgagctgagctggggtgagctgagctgagctgagctggggtgagctggggtgagctgagctgagctggagtgagctgagctgggctgagctggggtgagctgggctgagctggggtgagctgagctgagctgagctgagctggggtgagctgagctgagctggggtgagctgagctggggtgagctgggctgagctgagctgagctgagctgagctgagctgagctgagctgagctgagctgagctgagctgagctgagctgagctgagctgagctggggtgagctgagctgagctgggctgagctggggtgagctgggctgagctgggctgagctgggctgagctggggtgagctgagctggggtgagctgagctgagctgggctgagctgagctgagctggggtgagctgagctgagctggggtgagctgagctgagctgagctggggtgagctgagctgagctgggctgagcagggctgagctggggtgagctgagctgagctggggtgagctgggctgagctgggctgagctgagctgagctgggctgagctgggctgagctgggctgagctgggctgagctgggctgagctggggtgagctgagctggggtgagctggggtgagctgagctggggtgagctgagctggggtgagctgagctgagctggggtgagctgagctggggtgagctgagctgagctggggtgagctgagctgagctggggtgagctgagctagggtgaactgggctgggtgagctggagtgagctgagctgaggtgaactggggtgagccgggatgttttgagttgagctggggtaagatgagctgaactggggtaaactgggatgagctgtggtgagcggagctggattgaactgagctgtgtgagctgagctggggtcagctgagcaagagtgagtagagctggctggccagaaccagaatcaattaggctaagtgagccagattgtgctgggatcagctgtactcagatgagctgggatgaggtaggctgggatgagctgggctagctgacatggattatgtgaggctgagctagcatgggctggcctagctgatgagctaagcttgaatgagcggggctgagctggactcagatgtgctagactgagctgtactggatgatctggtgtagggtgatctggactcaactgggctggctgatgggatgcgccaggttgaactaggctcagataagttaggctgagtagggcctggttgagatggttcgggatgagctgggaaaagatggactcggaccatgaactgggctgagctgggttgggagaccatgaattgagctgaactgagtgcagctgggataaactgggttgagctaagaatagactacctgaattgtgccaaactcggctgggatcaattggaaattatcaggatttagatgagccggactaaactatgctgagctggactggttggatgtgttgaactggcctgctgctgggctggcatagctgagttgaacttaaatgaggaaggctgagcaaggctagcctgcttgcatagagctgaactttagcctagcctgagctggaccagcctgagctgagtaggtctaaactgagttaaaaatcaacagggataatttaacagctaatttaacaagcctgaggtctgagattgaatgagcagagctgggatgaactgaatgagtttcaccaggcctggaccagttaggctaggacctcgttctatagaggcagactgtgtgctacagtggagtttcaagatgattccatgagtcctccccgcccccaacataacccaccttcctcctaccctacacgcctgtctggtgtgtaaatcccagctttgtgtgctgatacagaagcctgagcccctcccccacctccacctacctattactttgggatgagaatagttctcccagccagtgtctcagagggaagccaagcaggacaggcccaaggctacttgagaagccaggatctaggcctctccctgagaacgggtgttcatgcccctagagttggctgaagggccagatccacctactctagaggcatctctccctgtctgtgaaggcttccaaagtcacgttcctgtggctagaaggcagctccatagccctgctgcagtttcgtcctgtataccaggttcacctactaccatatctagccctgcctgccttaagagtagcaacaaggaaatagcagggtgtagagggatctcctgtctgacaggaggcaagaagacagattcttacccctccatttctcttttatccctctctggtcctcagagagtcagtccttcccaaatgtcttccccctcgtctcctgcgagagccccctgtctgataagaatctggtggccatgggctgcctggcccgggacttcctgcccagcaccatttccttcacctggaactaccagaacaacactgaagtcatccagggtatcagaaccttcccaacactgaggacagggggcaagtacctagccacctcgcaggtgttgctgtctcccaagagcatccttgaaggttcagatgaatacctggtatgcaaaatccactacggaggcaaaaacaaagatctgcatgtgcccattccaggtaagaaccaaaccctcccagcaggggtgcccaggcccaggcatggcccagagggagcagcggggtggggcttaggccaagctgagctcacaccttgacctttcattccagctgtcgcagagatgaaccccaatgtaaatgtgttcgtcccaccacgggatggcttctctggccctgcaccacgcaagtctaaactcatctgcgaggccacgaacttcactccaaaaccgatcacagtatcctggctaaaggatgggaagctcgtggaatctggcttcaccacagatccggtgaccatcgagaacaaaggatccacaccccaaacctacaaggtcataagcacacttaccatctctgaaatcgactggctgaacctgaatgtgtacacctgccgtgtggatcacaggggtctcaccttcttgaagaacgtgtcctccacatgtgctgccagtgagtggcctgggctaagcccaatgcctagccctcccagattagggaagtcctcctacaattatggccaatgccacccagacatggtcatttgctccttgaactttggctccccagagtggccaaggacaagaatgagcaataggcagtagaggggtgagaatcagctggaaggaccagcatcttcccttaagtaggtttgggggatggagactaagcttttttccaacttcacaactagatatgtcataacctgacacagtgttctcttgactgcaggtccctccacagacatcctaaccttcaccatccccccctcctttgccgacatcttcctcagcaagtccgctaacctgacctgtctggtctcaaacctggcaacctatgaaaccctgaatatctcctgggcttctcaaagtggtgaaccactggaaaccaaaattaaaatcatggaaagccctcccaatggcaccttcagtgctaagggtgtggctagtgtttgtgtggaagactggaataacaggaaggaatttgtgcgtactgtgactcacagggatctgccttcaccacagaagaaattcatctcaaaacccaatggtaggtatccccccttcccttcccctccaattgcaggacccttcctgtacctcatagggagggcaggtcctcttccaccctatcctcactactgtcttcatttacagaggtgcacaaacatccacctgctgtgtacctgctgccaccagctcgtgagcaactgaacctgagggagtcagccacagtcacctgcctggtgaagggcttctctcctgcagacatcagtgtgcagtggcttcagagagggcaactcttgccccaagagaagtatgtgaccagtgccccgatgccagagcctggggccccaggcttctactttacccacagcatcctgactgtgacagaggaggaatggaactccggagagacctatacctgtgttgtaggccacgaggccctgccacacctggtgaccgagaggaccgtggacaagtccactggtaaacccacactgtacaatgtctccctgatcatgtctgacacaggcggcacctgctattgaccatgctagcgctcaaccaggcaggccctgggtgtccagttgctctgtgtatgcaaactaaccatgtcagagtgagatgttgcattttataaaaattagaaataaaaaaaatccattcaaacgtcactggttttgattatacaatgctcatgcctgctgagacagttgtgttttgcttgctctgcacacaccctgcatacttgcctccaccctggcccttcctctaccttgccagtttcctccttgtgtgtgaactcagtcaggcttacaacagacagagtatgaacatgcgattcctccagctacttctagatatatggctgaaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgaaccccttgcggccgc

SEQ ID NO: 7 - DNA, 17 bp, Artificial Sequence
  Description of Artificial Sequence: Synthetic oligonucleotide
tgcggccgatcttagcc

SEQ ID NO: 8 - DNA, 18 bp, Artificial Sequence
  Description of Artificial Sequence: Synthetic oligonucleotide
ttgaccgattccttgcgg

SEQ ID NO: 9 - DNA, 21 bp, Artificial Sequence
  Description of Artificial Sequence: Synthetic oligonucleotide
acgagcgggttcggcccattc

SEQ ID NO: 10 - DNA, 19 bp, Artificial Sequence
  Description of Artificial Sequence: Synthetic oligonucleotide
ggtggagaggctattcggc

SEQ ID NO: 11 - DNA, 17 bp, Artificial Sequence
  Description of Artificial Sequence: Synthetic oligonucleotide
gaacacggcggcatcag

SEQ ID NO: 12 - DNA, 23 bp, Artificial Sequence
  Description of Artificial Sequence: Synthetic oligonucleotide
tgggcacaacagacaatcggctg

SEQ ID NO: 13 - DNA, 19 bp, Artificial Sequence
  Description of Artificial Sequence: Synthetic oligonucleotide
tcctccaacgacaggtccc

SEQ ID NO: 14 - DNA, 20 bp, Artificial Sequence
  Description of Artificial Sequence: Synthetic oligonucleotide
gatgaactgacgggcacagg

SEQ ID NO: 15 - DNA, 24 bp, Artificial Sequence
  Description of Artificial Sequence: Synthetic oligonucleotide
tccctggaactctgccccgacaca

SEQ ID NO: 16 - DNA, 25 bp, Artificial Sequence
  Description of Artificial Sequence: Synthetic oligonucleotide
ctctgtggaaaatggtatggagatt

SEQ ID NO: 17 - DNA, 26 bp, Artificial Sequence
  Description of Artificial Sequence: Synthetic oligonucleotide
ggtaagcatagaaggtgggtatcttt

SEQ ID NO: 18 - DNA, 30 bp, Artificial Sequence
  Description of Artificial Sequence: Synthetic oligonucleotide
atagaactgtcatttggtccagcaatccca

SEQ ID NO: 19 - DNA, 20 bp, Artificial Sequence
  Description of Artificial Sequence: Synthetic oligonucleotide
tggtcacctccaggagcctc

SEQ ID NO: 20 - DNA, 21 bp, Artificial Sequence
  Description of Artificial Sequence: Synthetic oligonucleotide
gctgcagggtgtatcaggtgc

SEQ ID NO: 21 - DNA, 30 bp, Artificial Sequence
  Description of Artificial Sequence: Synthetic oligonucleotide
agtctctgcttcccccttgtggctatgagc

SEQ ID NO: 22 - DNA, 28 bp, Artificial Sequence
  Description of Artificial Sequence: Synthetic oligonucleotide
gatgggaagagactggtaacatttgtac

SEQ ID NO: 23 - DNA, 26 bp, Artificial Sequence
  Description of Artificial Sequence: Synthetic oligonucleotide
ttcctctatttcactctttgaggctc

SEQ ID NO: 24 - DNA, 27 bp, Artificial Sequence
  Description of Artificial Sequence: Synthetic oligonucleotide
cctccactgtgttaatggctgccacaa

SEQ ID NO: 25 - DNA, 23 bp, Artificial Sequence
  Description of Artificial Sequence: Synthetic oligonucleotide
ggtgtgcgatgtaccctctgaac

SEQ ID NO: 26 - DNA, 25 bp, Artificial Sequence
  Description of Artificial Sequence: Synthetic oligonucleotide
tgtggcagtttaatccagctttatc

SEQ ID NO: 27 - DNA, 32 bp, Artificial Sequence
  Description of Artificial Sequence: Synthetic oligonucleotide
ctaaaaatgctacacctggggcaaaacacctg

SEQ ID NO: 28 - DNA, 17 bp, Artificial Sequence
  Description of Artificial Sequence: Synthetic oligonucleotide
gccatgcaaggccaagc

SEQ ID NO: 29 - DNA, 24 bp, Artificial Sequence
  Description of Artificial Sequence: Synthetic oligonucleotide
agttcttgagccttagggtgctag

SEQ ID NO: 30 - DNA, 24 bp, Artificial Sequence
  Description of Artificial Sequence: Synthetic oligonucleotide
ccaggaaaatgctgccagagcctg

SEQ ID NO: 31 - DNA, 22 bp, Artificial Sequence
  Description of Artificial Sequence: Synthetic oligonucleotide
aactacgcacagaagttccagg

SEQ ID NO: 32 - DNA, 18 bp, Artificial Sequence
  Description of Artificial Sequence: Synthetic oligonucleotide
gctcgtggatttgtccgc

SEQ ID NO: 33 - DNA, 16 bp, Artificial Sequence
  Description of Artificial Sequence: Synthetic oligonucleotide
cagagtcacgattacc

SEQ ID NO: 34 - DNA, 19 bp, Artificial Sequence
  Description of Artificial Sequence: Synthetic oligonucleotide
tgagcagcaccctcacgtt

SEQ ID NO: 35 - DNA, 23 bp, Artificial Sequence
  Description of Artificial Sequence: Synthetic oligonucleotide
gtggcctcacaggtatagctgtt

SEQ ID NO: 36 - DNA, 18 bp, Artificial Sequence
  Description of Artificial Sequence: Synthetic oligonucleotide
accaaggacgagtatgaa

SEQ ID NO: 37 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 38 - protein, 98 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAR

SEQ ID NO: 39 - DNA, 294 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgaga

SEQ ID NO: 40 - protein, 98 aa, Homo sapiens
QVQLVQSGAEVKKPGSSVKVSCKASGGTFSSYTISWVRQAPGQGLEWMGRIIPILGIANYAQKFQGRVTITADKSTSTAYMELSSLRSEDTAVYYCAR

SEQ ID NO: 41 - DNA, 275 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgatgacacggc

SEQ ID NO: 42 - protein, 91 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSDDT

SEQ ID NO: 43 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 44 - protein, 98 aa, Homo sapiens
QVQLVQSGAEVKKPGSSVKVSCKASGGTFSSYAISWVRQAPGQGLEWMGRIIPILGIANYAQKFQGRVTITADKSTSTAYMELSSLRSEDTAVYYCAR

SEQ ID NO: 45 - DNA, 294 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggacgaatccacgagcacagcctacatggagctgagcagcctgagatctgaggacacggccgtgtattactgtgcgaga

SEQ ID NO: 46 - protein, 98 aa, Homo sapiens
QVQLVQSGAEVKKPGSSVKVSCKASGGTFSSYAISWVRQAPGQGLEWMGGIIPIFGTANYAQKFQGRVTITTDESTSTAYMELSSLRSEDTAVYYCAR

SEQ ID NO: 47 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 48 - protein, 98 aa, Homo sapiens
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAR

SEQ ID NO: 49 - DNA, 233 bp, Homo sapiens
agaagcctgggtcctcggtgaaggtctcctgcaaggcttctggaggcaccttcagcagctatgctatcagctgggtgcgacaggcccctggacaagggcttgagtggatgggaaggatcatccctatctttggtacagcaaactacgcacagaagttccagggcagagtcacgattaccgcggacgaatccacgagcacagcctacatggagctgagcagcctgagatctgag

SEQ ID NO: 50 - protein, 77 aa, Homo sapiens [sequence omitted]

SEQ ID NO: 51 - DNA, 296 bp, Homo sapiens
caggtccagctggtgcaatctggggctgaggtgaagaagcctgggtcctcggtgaaggtctcctgcaaggcttctggaggcaccttcagcagctatactatcagctgggtgcgacaggcccctggacaagggcttgagtggatgggaaggatcatccctatccttggtacagcaaactacgcacagaagttccagggcagagtcacgattaccgcggacaaatccacgagcacagcctacatggagctgagcagcctgagatctgaggacacggccgtgtattactgtgcgagaga

SEQ ID NO: 52 - protein, 98 aa, Homo sapiens
QVQLVQSGAEVKKPGSSVKVSCKASGGTFSSYTISWVRQAPGQGLEWMGRIIPILGTANYAQKFQGRVTITADKSTSTAYMELSSLRSEDTAVYYCAR

SEQ ID NO: 53 - DNA, 296 bp, Homo sapiens
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 54 - protein, 98 aa, Homo sapiens; identical to SEQ ID NO: 44

SEQ ID NO: 55 - DNA, 296 bp, Homo sapiens
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatccttggtatagcaaactacgcacagaagttccagggcagagtcacgattaccgcggacaaatccacgagcacagcctacatggagctgagcagcctgagatctgaggacacggccgtgtattactgtgcgagaga

SEQ ID NO: 56 - protein, 98 aa, Homo sapiens
QVQLVQSGAEVKKPGSSVKVSCKASGGTFSSYAISWVRQAPGQGLEWMGGIIPILGIANYAQKFQGRVTITADKSTSTAYMELSSLRSEDTAVYYCAR

SEQ ID NO: 57 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggaaggatcatccctatccttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 58 - protein, 98 aa, Homo sapiens
QVQLVQSGAEVKKPGSSVKVSCKASGGTFSSYAISWVRQAPGQGLEWMGRIIPILGTANYAQKFQGRVTITADESTSTAYMELSSLRSEDTAVYYCAR

SEQ ID NO: 59 - DNA, 296 bp, Homo sapiens
caggtccagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 60 - protein, 98 aa, Homo sapiens; identical to SEQ ID NO: 38

SEQ ID NO: 61 - DNA, 296 bp, Homo sapiens
caggtccagctggtgcagtctggggctgaggtgaagaagcctgggtcctcagtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagaga

SEQ ID NO: 62 - protein, 98 aa, Homo sapiens; identical to SEQ ID NO: 38

SEQ ID NO: 63 - DNA, 305 bp, Homo sapiens
gagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggacggatcaaccctaacagtggtggcacaaactatgcacagaagtttcagggcagggtcaccagtaccagggacacgtccatcagcacagcctacatggagctgagcaggctgagatctgacgacacggtcgtgtattactgtgcgaga

SEQ ID NO: 64 - protein, 98 aa, Homo sapiens
QVQLVQSGAEVKKPGASVKVSCKASGYTFTGYYMHWVRQAPGQGLEWMGRINPNSGGTNYAQKFQGRVTSTRDTSISTAYMELSRLRSDDTVVYYCAR

SEQ ID NO: 65 - DNA, 307 bp, Homo sapiens
gagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 66 - protein, 98 aa, Homo sapiens
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCAR

SEQ ID NO: 67 - DNA, 307 bp, Homo sapiens
  modified_base (124)..(124): a, c, t or g
gagcccactcccaggtgcagctggtgcagtctggggctgaggtgaagaagcttggggcctcagtgaaggtctcctgcaaggcttctggatacaccttcaccggctactatatgcactgggtgcnacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagaga

SEQ ID NO: 68 - protein, 98 aa, Homo sapiens
  MOD_RES (38)..(38): Any amino acid
QVQLVQSGAEVKKLGASVKVSCKASGYTFTGYYMHWVXQAPGQGLEWMGWINPNSGGTNYAQKFQGRVTMTRDTSISTAYMELSRLRSDDTAVYYCAR

SEQ ID NO: 69 - DNA, 294 bp, Homo sapiens
caggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggctgggtcaccatgaccagggacacgtccatcagcacagcctacatggagctgagcaggctgagatctgacgacacggccgtgtattactgtgcgaga

SEQ ID NO: 70 - protein, 98 aa, Homo sapiens
QVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCAR

SEQ ID NO: 71 - DNA, 346 bp, Homo sapiens
aggatgtgggttttcacactgtgtctctcgcacagtaatacacgaccgtgtcgtcagatctcagcctgctcagctccatgtaggctgtgctgatggacgtgtccctggtcatggtgaccctgccctgaaacttctgtgcatagtttgtgccaccactgttagggttgatccgtcccatccactcaagcccttgtccaggggcctgtcgcacccagtgcatatagtagccggtgaaggtgtatccagaagccttgcaggagaccttcactgaggccccaggcttcttcacctcagccccagactgcaccagctgcacctgggagtggacacctgtggagactcgcga

SEQ ID NO: 72 - protein, 98 aa, Homo sapiens
QVQLVQSGAEVKKPGASVKVSCKASGYTFTGYYMHWVRQAPGQGLEWMGRINPNSGGTNYAQKFQGRVTMTRDTSISTAYMELSRLRSDDTVVYYCAR

SEQ ID NO: 73 - DNA, 14781 bp, Artificial Sequence
  Description of Artificial Sequence: Synthetic polynucleotide
taactataacggtcctaaggtagcgagggatgacagattctctgttcagtgcactcagggtctgcctccacgagaatcaccatgtcctttctcaagactgtgttctgtgcagtgccctgtcagtggaaatctggagagcatgcttccatgagcttgtgagtagtatatctagtaagccatggctttgtgttaatggtgatgttctacatatcagttctctggcttaataatgaggtgatgattctatgttcctgtaacgcttcctcaactgggtcctaagtctttcttcactccatctattcctctaaggaatgatcctgaaaatcccatcacaaactataggagatgggaaccatcaaaaaacacagtgacaaagaggtgggaacgcatcagggttcaggaaccatattttaaaaagatatcgtaaataacttcttaaaagagatatagacaaatctccattaatacggagaccagaggcctaaggctaagaaccaatggtggctcaaggtctcctgctacccgaggagcaaacgtagagcagtttctaatgatttatttaaaatatagaatcaaaagtaccagtttgcaattttgaaagatttatttcagcaatgcaacaacatcaggtggtgccgagtccaacacgtcttatgtcccatgatataaacaaaggccatccagaactgtggactggagttctaccttgtcccctaatgacattcagattttttttccattctctttatcttagaggagacagggggctaactcattttacttgtcctttgcttgttcttgccaagaacgtaaagcagcttgcaagtcttcaaacctaaatatcttagtaactcctacacgagtggcaatgccaaagagcagtgcaacaaagaggaagtaaatacgaccaaagagtattcttaaatacactactggctctaggttctgttttattatgcgcctttgaaccggaggggacccactgtctatgctcccactgtgtccctcttctttgcactttggagggctccaaccaaaatggcaatggcaattccgacgattgttacacactcctctgaaattgcatttttctggggtgcagtcataacccaaacgagataaacttccattgcaagctcctcgatcacagaacttaccccttgaacacggggtaccatgtctcaccaatccagcatctgctgtttctgtcccacgatgttcatcaagcccaaagcaggtaaccccagagataaccgattgatggaatgaaacatgttcttgcaaaaatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccctcttctgagcatggtgtcccatcttgcagataagtgtcatctgggcaaatgaacttagagccactacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcattgttatctactttgaagtttccacaaaacttataagtcaatgatgtattataataaacatgacggtcatagaaaagacatggcatcagatcaggagtattaagtatgttgcttatctctgcaagggaacaattgctgaaagcatctgttaattgaggatttttgaacatgatgcaggtgttccttctctggcagatacagtacccctcatcatgttttaggcctaaactccttccaacacgattggttattataatagataaaaataaaggatttcgaccatgttgaccaagacaaattagggctgagggagaacatatactcctctcagctggattaacagcatcatctcctggcgaattcttgttaattatagctcctgcatcaggcctaaaatgagcataaaatactctctcatagaaagtatgagcctgccctcctggaactcgaaaatcttgtgaaaatggatcagcctcggtatacacagtcatgagaaagacatagtaccgcatatgaagattggtcagataggtgtccattaaactaatgactttaaacaaatactcaacagtagatgaaagtttgtcacctccagaagcactatatacagaatgggttgcttgaaagtggccttttatagcagctggatgtgtagcgtaattcttactagatagtctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggttatccaactttatgacccctgacaggcccccataacaagtatccacagtgaccatggattgcaggatcccctccaggtagccaatatagtaacaatctacaggaaaaaaggggtactccatctgtaaggctccttggtcatcttgagttgtcagcaacaagtgtctgggccaaatgagtgtctttctccgcaggtggatgatatgtctctggccccgaaaacgcaagctatacgagagcagtctttgtgcttgaagtcctttggtatggtagatctccttccgaggaataaccacctccgatgagatgtaacgccaagtgggatggccttgagaacaccagactggaaccaggaggagcagccagagtgcaaatagcaagaggaggaccctggggaccacaggtctttccactagcctcatgccccaggtcagagataacatcctgggtggagctaactccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttttcacagttgttctaacttcttgttttgttttgtttgtttgtttgtttgaaagttagaagtaaatactgtctatattagccttttagctataaatgattgtttttatttcttctaatcatgttttgtttgagttttggttaaactatttacaaatgagttttttttttccttttgggtgttgctcgaaagtttggagctttctgttaatattgtgttgttgtttctccaatattattagacctgagaattctacctgggtacctgtgaactccagaatttttaaaaattccatctcttgggaacattatctctgaccccgtctgaggccgaagtggctgtccccctccaacctttagtatctttctttcctgactattgggatttcttcaagcaatcaggctgatgggttctcagcagtgagaccagtagactgtcggtatgaacgtcgaagagtctgccacacactccgggttcatcaacagtgctttcgcgtctcttacttttgtagaaggaaatgcagcctctgagttttctccaagaaatcattgatgaaagggtgaaaagatgggtatcacccggagttcatgacaagccctggctcagacacgtgagcaaggtctacagccccaaagataggctgccctgcaacatgtatttataagataggagaaaaaaatgggtagttggagggttgatcaacttacttcctctcaaacatatatatctcatctaagtgtgcaggggaaaactctgtagaactactgggatacctgctcacccccaggagcctcatgaataagtctctgcttctgccttgtagccatgagcattactgcacctgatacccctgcagcttcctagggaagagggaggaagtgacttggcccctgtctggttaaggtaagaggagataaatcccttctcattgattagggtgagaggggtcatgtgctctatcattggtgacccagttgggacatgggtttataccaaagtcatcactctgaggttctgtgtaccaccaggctgaactcccatatcctacatggacataggacaacaccaagcagaaggaggttttaggactaaactgaaggacagagatgcggtttctaaacaactagggagtgccagggccagcctctctaaccactataggacactgtggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaagggagggagggagagagagagaaggctaagtctttccatacctgggtcccaatacctcttataacccaagcacatggtttcacatatcacaatgcggttgggatatagataactgtaaatacttgtgaaaataatggggctgagatctggggttttcatgatagtttcaaagtcaccgtactgactaaaaccttccactggcccatctccagcttcctaatctgagggtatcaaatttcccactaagtgtgtttagaaagatctccacctttttgcccttgtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaaaggtaggcatgtagaagctgaagcatctcacctcattccaagcaccctcagtctctaaatgtgcccccttgtttccagaagtgcaacctcaagcatcttttattcattcatcttagagggccacatgtgctgtagtgttataagatgaaatttaaagcattaattattcctaacaagccaattaaacaagccaaaaacattcatcagtcattcccatggaacctctgaagcatcttcctgctctaaccttgggttttccagggctgctctgggatcacaggagctgtcctgtctaccagccatataaaggcagacctatcagaattacaccagacttctcaccatagactataaaagccagaatatcctggacagatgttatacagaaactaagagaacacaaatgccagcccaggctactatacccagcaaaactctcaattaccatcgatgaagaaaccaagatattccattacaagtccaaatttacacaatatctttccataaatccagccctacaaaggatagcagatggaaaactccaacacaggtaggaaaactacaccctagaaagagcactaaagtaatcatctttcaacacactcaaaagaagataaccacacaaacataattccacctctaacaacaaaaataaagtaggcaacaatcactattccttaatatctcttttaacatcaatggactcaattctccaataaaaagacatagactaacagactgaatacataaacaggacacagcattttgctgcataaagcaaacacagcgttacttttttttttctaaatgacattttttattagatattgtctttattgacatttcaaatgttatcccctttcctggtttaccctctgaaatcccctatctcctccccctccccctgctcaccaatccacccactcccacttccaggccctggcaatcccctatatttgggcatagagccttcacaggaccaaggtactctccttgcattgatgaccaactagtccattctctgctacaaatgcagctagatctatgagtcccaccatgttttcttttgttggtggtttcatgccagggagctcttggagtactgattggttcatattgttgttctccctatggggttacaaaacccttcaacttcttgggtcctttctctggctgcctcattggggaccttgtgcgaagtccaatggatgactgtgagcatccacttctgtatttgccaggcactggcagagcctctcagaagacagctatatcaagatcctggcagcaagctcttgttggtatccacaaaagtgtctggtggttgtctatgggatggatccccaaaggggcagtctctggatggtcattccttcagtctctgttccacactttgtctctttaactccttccatgactattttattcctccctctaagaaggaccgaagtattcatactttggtcttccttcttgaaattcatgtgttttgtgaattgtatctttgatattccgaacttctgggctaatatccacttatcagtgagtgaatatcatgtgtgttcttatgtgattgagttacctcactcaggatgatatcctccagaaccatccatttgtctaagaatttaatgaattcattgtttttaatagctgaggagtactccattgtgtaaatgtaccacattttctgtacccattgttctcttgagggacatctgggttctttaaagcttctggacattaaatataaggctgctatggaaatagtggagaatgtgtccttattacatgttggagcatcttctgggtatatgcccaggagtgctattgctggatcctctgatagtactatgtccaattttctgaggaactgccaaactgatttacagagtggttgtaccagcttgcaattccaccagcaatggagaaatgttccccttcctccacatcctcaccaacatctgctgtcacctcaatttgttcttagtgattcagacaggtgtgaggtggaatatcagggttgtttggcatttccctgatgactagtgatattgaaaaaaattttaagtgtttctcagccattcagtattcttcagttgagaattcactgtttagctctgtactcaggtttttttaatagggttatttggttttctggagtctaacgtcttgaattctttctatatattggatattagccctctgtcatatttaggattggtaaagatctttcccaatatgttggctgcctttttgtgtcctttgccttacagaacctttttaattttatgaggtcccatttgctaattcttcattttacagcacaagccattggtgttctgttcaaaaatctttccccctgaaccctatcttcgaggatcttccccactttctcctctataagtttcagtgtctctattattgtgctgagggcgatcgcaccggtgaaaccctaggaagttcctatactttctagagaataggaacttcggaataggaacttctctaggggctgcaggtcgaggtctgatggaattagaacttggcaaaacaatactgagaatgaagtgtatgtggaacagaggctgctgatctcgttcttcaggctatgaaactgacacatttggaaaccacagtacttagaaccacaaagtgggaatcaagagaaaaacaatgatcccacgagagatctatagatctatagatcatgagtgggaggaatgagctggcccttaatttggttttgcttgtttaaattatgatatccaactatgaaacattatcataaagcaatagtaaagagccttcagtaaagagcaggcatttatctaatcccaccccacccccacccccgtagctccaatccttccattcaaaatgtaggtactctgttctcacccttcttaacaaagtatgacaggaaaaacttccattttagtggacatctttattgtttaatagatcatcaatttctgcagacttacagcggatcttcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatggtggatggtttagttcctcaccttgtcgtattatactatgccgatatactatgccgatgattaattgtcaacaattcgagagacccgggttcccaatctagagctcgacgtctaacaaaaaagccaaaaacggccagaatttagcggacaatttactagtctaacactgaaaattacatattgacccaaatgattacatttcaaaaggtgcctaaaaaacttcacaaaacacactcgccaaccccgagcgcatagttcaaaaccggagcttcagctacttaagaagataggtacataaaaccgaccaaagaaactgacgcctcacttatccctcccctcaccagaggtccggcgcctgtcgattcaggagagcctaccctaggcccgaaccctgcgtcctgcgacggagaaaagcctaccgcacacctaccggcaggtggccccaccctgcattataagccaacagaacgggtgacgtcacgacacgacgagggcgcgcgctcccaaaggtacgggtgcactgcccaacggcaccgccataactgccgcccccgcaacagacgacaaaccgagttctccagtcagtgacaaacttcacgtcagggtccccagatggtgccccagcccatctcacccgaataagagctttcccgcattagcgaaggcctcaagaccttgggttcttgccgcccaccatgccccccaccttgtttcaacgacctcacagcccgcctcacaagcgtcttccattcaagactcgggaacagccgccattttgctgcgctccccccaacccccagttcagggcaaccttgctcgcggacccagactacagcccttggcggtctctccacacgcttccgtcccaccgagcggcccggcggccacgaaagccccggccagcccagcagcccgctactcaccaagtgacgatcacagcgatccacaaacaagaaccgcgacccaaatcccggctgcgacggaactagctgtgccacacccggcgcgtccttatataatcatcggcgttcaccgccccacggagatccctccgcagaatcgccgagaagggactacttttcctcgcctgttccgctctctggaaagaaaaccagtgccctagagtcacccaagtcccgtcctaaaatgtccttctgctgatactggggttctaaggccgagtcttatgagcagcgggccgctgtcctgagcgtccgggcggaaggatcaggacgctcgctgcgcccttcgtctgacgtggcagcgctcgccgtgaggaggggggcgcccgcgggaggcgccaaaacccggcgcggaggcctcggaggccagacgcgcgagaagttcctatactttctagagaataggaacttcggaataggaacttcggtaccgcgatcgcgatgtgggaacgcttcagtgttcaggaaccatatgatttatttaaaatatagaatcaaaagtaccaatttgcagttttgaaagatttattccagtgtaagcattagcaatgcaccaacatcaggtgatttctgaatccaacacgtcttatgtcctcatgatattaaaaaaaaaaaaaggccatccagaactgtgaacttgagttctaccttgttccctactgacattcagattttcttttttgcattctctttatcttacaggagacaggaggggagggctaactcattttactttggcttgtcccttgctggtccttgcccagaacgtaaagtagcttgcaagtcttcaaatctaaaaatcttagtaactcctacacgagtggcaatgccaaagagcagtgcaacaaagaggaagtaaatacgaccaaagagtattcttaaatacaccactggctcttgtttttgttttattgtgtgcctttgaactggaggggacccactgtctatgctcccacttagtccctcttctttgcactctggaggcttccaaccaaaatgacaatggcaattccgatgattgttacacactcctctaaaactgcatttttctggggtgcagtcataacccaaatgagataaacttccactgcaagctccttgatcacagaacttacttttggagcagggggtaccatgtctcaccattccagcatctgttgtttctgtcccacgatgttcatcaagcccaaagcaggtaaacccagagataatcgattgatggaatgaaacatgttcttgcaaatatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccatcttctgagcatggtgtcccatcttgcagataagtgtcatctgggcaaatgtatttagtcccattacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcatcgttatctactttgaagtttccacaaaacttataagtcaatgatgtattataataaacatgacggtcatagaaaagacatggcatcagaccaggagtattaagtatgttgcttatctctgcaagggaacaattgctgaaagcatctgttaattgaggatgtctgaacataatgcaggtgttccttctctggcagacacagtacccctcatcatattttaagcctaaactccttccaacacgattggttattataggagataaaaataaaggatttcgatcatatttaccaatacaaattagggctaaggaagaacatatactcctctcagctggattaacctggttatcttgtggcccatacttattaagtaaaactcctgcatcaggcttaaatttattataaaagactgacacatagtaattataagccgaccctcctggaactgcaaactcaagtcgaaatggatcagaattggtgtacacagtcatgagaaagacatagtaccgcatatgaagattggtcagataggtgtccattaaactaatgacttgaaacaaatacccaacagtagatgaaagtttgtcacctgcagcagaattatatacagaattggttgcttgaaagtggccttttatagcagctggatgtgtagcgtagttcttactagatattctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggtcatctaacttcatgacccctgacaggcccccataacaagtatccacagtgaccatggattgtgggatcccctccaggtagccaatatagtaacaatctacaggaaaaaaggggtaatccatctgtaaggctccttggtcatcttgagttgtcagcaacaagtgtctgggccaaatgagtgtctttctccgcaggtggatgatatgtctctggccccgaaaatgcaagctatatgagagcagtctttgtgcttgaagtcctttggtatggtagatctccttccgaggaataaccacctccgatgagatgtaacgccaagtaggatggccttgagaacaccagactggaaccaggaggagcagccagagtgcaaatagcaagaggaggaccctggggaccacaggtctttccactagcctcatgccccaggtcagagataacatcctgggtggagctaaatccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttctcacagttgttctaatttcttgttttgttttgtttgtttgtttgaacgttagtagtaaatactgtctatattagccttttagctataaatgattgtttttatttcttctaatcatattttgtttgagttttggttaaactatttacaaatgagttttttttttttccttttgggtgttgctcgaaagtttggagctttctgttaatattgtgttgttatttttccaatattattagacctgagaattctatctgggtacctgtgaactctagaatttttaaaaattccatctcttgggaacattacctctgaccccgtctgaggccgaagtggctgtccccctccaacctttagtatctttctttcctgactattgggatttcttcaagcaatcaggctgatgggttctcagcagtgagaccagtagactgccggtatgaacgtcgaagagactgccacacactccaggttcatcaacagtgctttcgcgtctcttacttttgtagaaggaaaagcagcctctgagttatctccaagaaatcattaatgaaagagttaaaagatgggtatcacccggagttcatgacaagccctggctcagacacgtgagcaaggtctacagccccaaagataggctgccctgcaacatgtatttataagatagaagaaaaaaatgggtggttggagggttgatcaacttacttcctctcaaacatatatatctcatctaagtgtgcaggggaaaactctgtaggactactgggattgttattatcattattattattattattattattattattattattattattattaacttaaggcattttattagatattttcttcatttagttttcaaatgttatccccggaacctcctatactctctccctgccctgctccccaacccacccactcctacatcctggccctggcattcccctatactgtggcagatgatcttcgtaagaccaagagcctttcctcccattgatggcctactaggctatcctcttttacatatgcaactagagtcacagctctggggaggtattgcttagttcatattgtttttcctcctatagggttgcagatccctttagctccttgggtactttctctagctcctccattgggggccctgtgttccatccaatagatgactgtgagcatccacttctgtatttgccaggtattggcatggatcttactgcaccttctgaactctctaagcagctttcctggtcggcgcgcc

SEQ ID NO: 74 - DNA, 117034 bp, Artificial Sequence
  Description of Artificial Sequence: Synthetic polynucleotide
aagcttatctctctgttgctcagactcatctaggaatttcagaaatttctgttctagcatctcttccagcttttgtctccaaccctcattctcttctttctttttttttttaaattatatgttctctgtctttttaaaaaactttttaaaattaggtatttatgtcatttacatttccaatgctatcccaaaagtcccacccacgctccccaacccactatcccacccacccactcccacttcttggccctggcattcacagtgtactgagacatataaagtttgcacaaccaatgggcctctctttccactgatggccgactaggccatcttctgatacatatgcagctagagacacgagattctgggggtactggttagttcatattgttgttccacctatagggttgcagatccttttagctccttgggtactttctctagctcctccattgggggccctgtgatccatccaatagctgactgtgagcatccacttctgtgtttgctaggccccagatagtctcacaagagacagctatatctgggtcctttcagcaaaatcttgctagtgtatgcaacggtgtcagagtttggaagctgattatgggatggatccccggatatggcattctctagttggttcatccttttgtctcagctccaaactttgtctctgtaactccttccatgggtgttttgttcccagttctaaggaggggcaaagtatccacactttggtcttcattcttcttgagtttcatgtgttttgcaaattgtatcttatatcttgggtattctaagtttctgggctaatatccacttatcagtgagtacacattgtgtgagttcttttgtgattgggttacctcactcagtatgatgccctccaggtccatccatttgcctaggaatttcataaattcattctttttaatagctcagtagtactccattgtgtagatgtaccacattttctgtattcattcctctgttgaggggcatctgggttctttccagcttctggctattataaataaggctgctatgaacatagtggagcatgtgaccttcttaccggttgggacatcttctggatatatgcccaggagaggtattgctggatcttccggtagtactatgtccaattttctgaggaactgacaaactgatttccagagtggttagtaccagcttgcaatcccaccaacaatgagaggagtgttcgtctttctccacatcctcaccagcatgctgctgtcacctgaatttttgatgcttagccattctgactggtgtgaggtggaatctcagggttgttttgatttgtatttccctgatgattaaggatgctgaacattttctcaggtgcttctcagccattcagtattctttaggtgagaattctttgtttagctctaagccccatttttttaatggggttatttgattttctggagtccaccttcttgagtttttttttccattttttattacataatttcctcaattacatttccaatgctatcccaaaagtcccccataccctcccccccccaattccctacccaccccttcccatttttttggccctggcgttcccctgtactggggcatataaagtttgtgtgtccaatgggcttctctttccagtgatggctgactaggccatcttttgatacatatgcagctagagtcaagagctcccgggtactggttagttcataatgttgttccacctatagggttgcagatccctttagcttcttgggtactttctctagctcctccattgggagccctgtgatccatccaatagctgactgtgagcatccacttctgtgtttgctaggccccggcatagtctcacaagagacagctacatctgggtccttttgataaaatcttgctagtgtatgcaagggtgtcagcatttggaagctgattatggggtggatccctggatatggcagtctctacatggtccatccttttgtctcagctccaaactttgtctctgtaacttcttccatgagtgttttgttcccaattctaaggaggggcatagtgtccacacttcattcttcattcttcttgagtttcatgtgtttagcaaattgtatcttatatcttgggtatcctaggttttgggctaatatccacttatcagtgagtacatattgtgtgagttcctttgtaaatgtgttacctcactcaggatgacgccctccaggtccatccatttggctaggaatttcataaattcattctttttaatagctgagtagtactccattgtgtaaatgtaccacattttctgtactcattcctctgttgaggggcatctgggttctttataggttctggctattataaataaggttgctatgaacatagtggagcatgtgtccttcttaccggttgagacatcttctggatatatgcccaggcgaggtattgctggatcctccggtagtactatgtccaattttctgaggaactgccagactgatttccagagtggttgtacaagcctgcactctcaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacatttttttcaggtgcttctctgccattcggtattcctcaggtgagaattctttgttcagttctgagccccattttttaatggggttatttgattttctgaagtccaccttcttgagttctttatatatgttggatattagtcccctatctgatttacgataggtaaagatcctttcccaatctgttggtggtctttttctcttattgacggtgtcttttgccttgcagaaactttggagtgagttctttatatatattggatattagtcccctatctgatttaggataggtaaagatcctttcccaatctgttggtgacctttttgtcttattgacggtgtcttttgccttgcagaatctttgcaattttatgaggtcgcatttgtcaattctcgatcttacagcacaagtcattgctgttctgttcaggaatttttcctctgtgcccatatcttcgaggcttttacctgctttctcctctatatgtttgagtgtctctggtttaatgtggagttccttaatccacttagatttgaccttagtacaaggagataggaatggatcaattcgcattcttctacatgataaccgctagttgtgccagcaccatttgttgataatgctgtcttttttccactggatggtttttgctcccttgtctaagatcaagtgaccataggtgtgtgggttcatttctgggtcttcaattctatttcattggtctacttgtctgttgttataccagtaccatgcagattttatcacaattgctctgtagtagagttttaggtcaggcatggtgattacaccagaggttttttttatccttgagcagagtttttgctatcctaggttttgtgttatttcagatgaatttgcagattgccctttccagttcgttgaagaattgagttggaattttgatggggattgcattgaatctgtagattgctttggcaatatagccatttttactatattgatcctgccaatccatgagcatgggagatctttccatcttctcaaatcttctttaatttctttcttcagagacttgaagttcttgtcatacagatctttcacttccttagttagagtcacgctaaggtattttatattatttgtgactattgagaagggtgttgtttccctaatttctttctcagcctgtttatcctttgtgtacagaaaagccattgacttgtgttagttaatctcatatccagctacttcactgaagcggtttatcaggtttaggagttctctggtgtaatttttagggtcactcatatatactatcatatcatctgcaaaaagtgacattttgacttcttcctttccaatttgtatccccttgatctccttttgttgtcgaattgctctggcaaggacatcaagtactatattgaataggtagggagaaaatcggcacccttgtctagtccctgattttagtaggattgcttcaagtttctcaccatttactttgatgttggctactggtttgctgttgaatgctttttatcatgtttaggtatgggccttgaattcctgatctttccaagacttttatcatgaaagggtgttggattttgtcaaatgctttctccagcctttcattctgaggttgtgtctgtctttttccctgagatgggtttcctgtaagcagcaaaatgttgggtcctgtttgtgtagcccgtctgttattctatgtctttttattggggagttgagtccattgatattaagatatattaaggaaaagtaattgttgcttcctattatttttgtttttaaagttggcattctgttcttgtggctgtcttcttttaggtttgttgaaggattcctttcttgctttttctaggtcgtggtttccatccttgtattcattttttttctgttattatcctttgaaggactggattcatggatagataatgtgtgaatttggttttgtcttggaatacttttgtttctccatctacggtaattgagagtttggctgggtatagtagcctgggctggcaattgtgttgtcttagtgtctatataatgtctgtccaggatcttctggctttcatagtctgtggtgaaaaatctggtgtaattctgataggcttgcctttatatgttacttgaatttttcacttactgcttttaatattctttctttatttagtgcatttgttgttctgattattatgtgtcgggaggaatttcttttctggtccagtctatttggagttctgtaggcttcttgtatgttcacgggcatctctttctttaggtttgggaagttttcttctataattttgttgaagatatttgctggcccttcaagttgaaaatgttcattctcatctactcctattattcgtatggttggtcttctcattgtgtcctggatttcctggatgttttgagttaggatctttttgcattttccattttctttgattgttgtgcagatgttctctatggaatcttctgcacctgatattctctcttccatctcttgtagtctgttgctgatgctcgcatctatggttccagatttctttcctagggtttctatctccagtgttgccccactttgggttttctgtatagtgtctacttccctttttagatctagtatggttttgttcatttccatcacctgtttgggtgtgttttcctgtttttctttaaagacttgcaactctttagcagagttctcctgtatttaagtgagttattaaagtccttcttgatgtccagtaccataattgtgagatatgcctttaaatccaagtctaggtttttgggtgtgttggggtgccctggactggctgagttgggagtgctgcattctgatgatggtgagtggtcttggtttctgctagtaagattcttacatctgcctttcgccatctggtaatctctggagtcagttgttaaagttgtctctggttaaagcttgttcctctcgtgattctgttattctcttccagcagacctgggagactagctctttcctgagtttcagtggtcagagcactctctgcaggcaggatttcctctttcagggaaggtgcacagatatctggtgttcagatttgcctcctggcagaagatgatggcctgaaacaggacctgtcccagaagctgttagcttctgtagtcaacactgtcacctgtgcagactagtctcggtggagtccgggaaccaagatgtctcctgcagatgctctggcattcccttctgggccgggtgatcacctctcctctggcagggaaggtgccctggtgtctggaacccgaaaagggggctgcctcagaagctctgtggctactgcctgtcccagaagctgttagcttctgtagtccacactctcacctgtgcagactagtcttggtggagtctgggaaccaagatgtctcccgcagatgctccagccattctcctctttctgttgcttattttgacctatgaaatcctggacatatagttctagtgttgcttgtaatctcttttctaagccaaggaattttttttatctagggcacaatcttttgagaagacatattaaatcaagagaataaatattgcaagaccaataaatgataaggtatctattttctttaaatccatcgctgtcaaaccattcaaaatatcctcacataaagccaaaaagatatttattgtgtttcccatcttagttgagttcaagtcaatattttggtgccattttgttgcagtaaatctctaacacaaatatgcctgggcaatgaaaacacaactcagttaatatgaatacagattgttcagatctaccactacactaccatcttcttcatctaagagaccccttagaacttgcagtttctccaggccttgtgcttctgcgctgcttttcttcttcttcctcttctacattgcttctctcataaacctacttctttttttccctccttctgttccatcttcccttttatctgcccaatcattagctctcctttattttacaaattaaggtgtgaagccggtttctaggaaatcacctgagtgctgacttgttccttgttcagagccacgcacaggagaacagaattaacatcaaatataattatccccagggctatccacaacacgtgcatcctataagatcaccacggactaatgctggtcttcaattacaacataaacaacaaaaaccccacatatatgtggaaacaaatcgaactatacaaagaatcaatgaaaccaggagcttgttctttgagaaaaatcaacaagatagataaacccttagccagactaaccagagggcacagagacagtatccaaattaataaagtcagaaatgaaaggaagacataacaatgaaatatatcttaaaataattaatctgtttgtagactattagcagttgaaaatattaaaatcatgttctacaaacgtggaattattattgataattttctcactgtgcttgaaattagcattttcttaatgtttaacttcaaagagtttttgctattttgaaatattaaacatatacttactgataaaataatttccctcctaacaacactgataatctttttttaagtaaactgattattagacaatgtacacagatatataatgtgttttaaatactctcccactgtcaggtggtatcatatagggcctttgaatatatttttaaatgtattatttgtaatattttatggtctctcctatgcttatttctgaaagaatattttgtatgttttgaaacaatttagtatttaacattagatataggatcctcagttatggatagtattaaatattcattaatgatatttttaaggtataaaaggatatgaatataaaagtttaacaaattttatgtattatttgattctaaaaatactcaatattattaatatgtttgatgtttaaaatgcatttaaataataaaaacatttaaaaaaataaaatcaagaaatgaggttctaagcagaggtcaaggaaaatgaggaatagaaaaatagtaaaaatcaatatgtccatttattcaaggaaagctcctacatagacattgcaccagattagcaaatattatggtcctcatattagtttaagttaggagactatgcttatgttatctatttacattctaaggagcctagacatttgtgaatggattacattataagaggaggatgtctacttaagtaggcatgaacgcctgtgcattgcaccctatgagttccatcagcattccatgattggagtatgaagaacagcattatagacattacccagaaccttagtggttctagaatgccaagataaaacaatctaaccttctggatagtagggataaatgttcctatatcatcagaattcactggtgccctgaggatgttaccctgctaactgacaattcacaggacatcacatggattctgataagttgcagaaaagaggagatgcattcaattggtcctcctccttctaagctgcaatattaggtgcatccaatttgtgaacttcaatttagattacaatagacatgaataatctgaattcatgtagtacatatttttgttttaatatgagttaccattgttcagaaaattaaatacacatgatcacatattcctacatagtgctgttagtttttcacatctctgggacaatattccaaatatctccttcattagtgaaaatatcaactactgtaaagcttagctaacatgcctttgcaggaataagaacatcctggattgaaagctacacagggagatgtaaaactttctaagcacacacattctccatccattaggatcatggtccatgagatttttctctctctcttcttcccattaaatgcatgtacatgcaggttgggaaacagattgtgttgcagaatacatttgcttgatttccacttccttctcaatgcaaatatttttgaagtgttaattttgctgtgagtaccacagtggttcttgctctttctgttgactcctgtctgtgaatgttccaggaattcacacatggacacacgtggggctgcatctgagctccagactcactgttgtccttctgtcctcagctgctctggcccaggcacagcctcgtgaattcaacaaagaccctgatctctcttgtttacacctcattacaaatgggaactgttagaggtggacccaactgcatttccatgaggaaagcacatgagtttgagagggtcgttgatgataaggtagaaacaactttaattcataggctgagatatcagtcatcacctccagataaacaagagccatttcttcctgcatctgagccctgtaagcacactagctttaggaatatgttactgctgaagtcagattgggcaacttcatagtatacaatagaaaatctacctgcagatgagttcagaaccagcagggggcacaatggggccaagaatccctagcagagagatgtggtgtgtgtgcaggggactctgcatcctctgtggtttcctttcttaacttacatgtacctgtagtgattgacatgtaacgtttccacgctcaaacactgtgaagatactttgctaaacacttcaaagatttatgttttcttgatgtgtgcatgtgtgtattcttttttgtttttagacacagggtttctctgtgtagtcctggctgccctggaactcactctgtagaccaggctggcctcgaactcagaaatctgcctgcttctgcctcccaagtgctgaagttaaagacatgtgccaccattgcctggccatgtgtgtattcttgatgcactcttctgttgacagatacacagtttatttccataatttatttattgtgatggtgctgcaataatcacttatgtacaaatgtttctgaagtatatttagttttggtcatttgggtgattatttttttctttctagtatatagcattttggaaaggtagatattaattgtatgtatgggaaggaggctgtaaattctaataacttagctgcttttgaaatttgtcctcaattctatcatccttgtaaccaccttaaatccatctattagccttgtcacaagtgagccactgtctcaggctgcaaatctttttatagattaggtcgtgatgttacatccacagcctctgcacaatgctcaggggtgggatatgggatgaattccctcagacagcattaggacttggatctcagcagactgattcttgacccaaatgtctcttcttctctagcaggagtaagtccttatctaagatgtactctgctcatgaatatgcaaatcaattgagtctatggtggtaaatatagggatgtctacacccctcaaaaacttaagatcactgtcgtcttcacagtcacaggagtacacaggacatcaccatgtgttggagctgtatcatcctcttcctgttagcaacagctgcacgtaaggggcttacagtagcaggcttgaggtctggccatacactcatgtgacaatgacatccactctgtccttcccttcacaggtgtgcactcccaggtccagctgcagcagtctggggctgagctggtgaggcctggggcctcagtgaagatttcctgcaaggcttttggctacaccttcacaaaccatcatataaactgggtgaagcagaggcctggacagggcctggactggattggatatattaatccttataatgattatactagctacagaaccagaagttcaagggcaaggccacattgactgtagacaaatcctccagcacagcctatatggagcttagcagcctgacatctgaggactctgcagtctattactgtgcaagacacagtgctacaaacacatcctgagtgtgtcagaaaccctggaggagaagcaagcagagctggaatggagatgacagaaagattatcatttagacttgctcagaaagagaaattttgaatgcccatttattgcctcttccttacagtactatagtgcctgtttttgttgacattttcaaactaatttccaaagtcactaccacaatttacaatcacataaaaagcaagcaaggataacattattttctgtgcttacttgccatttatattcttgcttattctcatctcactgaggtcatattgggacattaaatttctggggttactttttattaaaaatttttcattattcattcactttacatccttctagtcttcctctcacacatgccctatccctttctcctctgagaggatggagccctccctaccctcgtatccccttacccaggcacatcaagtgtctgcagtactaggaatattctctgtcaatgctgccagacaaggcagacaagttaggggatcaggattcacaggaaggcaacagcttgagggacagcccccactgaagttattggtggattcacatgaagactgagttgcacatctgctacatatattcaggggtcctatttacagctcaagtagactcttgttggtggtttagtctcttagaaccccaagtgtccaggttagttgactctgtgggtcttcctttggagttcctatcccctccagatccctcagttcttctcccaactcttccataagacacccgtaggtccatccaatgtttggttttgggtttttctgcatctgcttcagtcagctgctgggtggagcatctctgaggataattatgagaagctcttatgtgcaagcataacaggatatcattattagtgtcagggactggtgcttggccatgggatgggtctcaagtttggtcagttatttggccattcccacagtctctgataatctttgtccctgcatttcttgtagacaggaaaaatattgggttgaaagttttgtgggtgggttggcgtctctattgctccactgggcttctttctggatataggagtttgcctcttcaggttccatattcccaaagtagtgtgtcacactaaggtcactcccatacagagggacactcattctcttgccacgtctctgtccaccttcattggacctgaggttcctgaatcatacagaactgcatgtgtgcaaccacacagaacaaggctatctatcagaggcctaccataccaggaccatcaaggttcaccttactcccaatactgactacaaaaagaacatcaaggaccaatgcagtctatatggataaacacacttgaaagaacacaaacaagattgagggcaacatgacacctccaaagcatacctaaccgagtacagcatgccctggatatcctaacacaatcaaaacacaagaaagttaccttaaatccagtcttataaaggtgatgaaggcctttaaataggaaatgaattaatccttaggataatacaggacaatacattcgaacagatagaggtctttaggaggaaagaaataaatccctcaaagacatacatgaaaatacaattaaacaggtgaaagtaataactacaatggtgtaagacctaaaaatggaaatagaagcaataaagtaacacaaacttagaatcttgaaggtggaaaacctagagaacaggaatactagatgcaaggatgatatcttctaggtccatccatttgcttgcacaatttatcatgtccttgcttttaatagttgaacagtatttcattgtttaaatgaaccacatgttctgtctccattctctggatgagggggtgagcaagtttttccacattctggctattacaaatagagctgctatgaacctagtagaaaacatatcctgtgtatggtggagagttttggagtatatcaccaagagtgttatagctgggtcttcatgtagaactattcctaattttctgagaaatcccaagtcagatttctagaatggttgttcaagtgttcactccaaccatcaatggaggactgttttccttgccagcatgtgctgtattttgagtttttgatcctagccagttttatcctgcatttcacacttagatatggactatggtacaggacagagagaaaccaaccttctactcaccaggatattctacctgctaccaatttatttatttatttatttatttatttatttatttatttatttatttatattagagaacaacaccatgcagtttagaagaagtactaagacgtcagtgatgttatactgtgcctaaccttgcattgtacaatctcagctttcaggtaagacagtgcatgactcttatgcagtgccaactgttttctgattgtatttatggtctattgcctaggaatgacctcctctcaaataaacatggtcaaaagcccatggcctgagatgacagagcccctagtagaccctagttgtatttctgaagtttagatatcataatgacttataaatacttatgtttatacaatagattagagctgctctcagccatgaccaaggagcttctgtgttcaatgaataatgattgatgcagacattcgtgagtggtcaaagtggtgagaatgattagagagtcctcagccacacaagcgttaatgatatgaactttccaatatattaactgtattaatgaataaatgcagacatcatatgagatctcattagtagttcttaggtattgcatttttatatacaattatgcatatcagtacattatagtgtataaaggaaattgtctagcataatagagaaaaataggacagtcaagaaacaaaagagtagaaattatgggtgaaatatgcagtgtgaaatatttacatgaaaattttaaccatatgtaaaattgttatttttgtttttcagaatgagtttgctcattctttgacatttttattcctgtgtgaaatatatcaggatcatatgtatcccattctgatggtctgacttccactgggaatttccaatatatctcttccaactaactgaccagtttctttttttcttattttctctctttctcgttttgttttgctttgttttgtttttcaagacagggtttctctgtgtagctctggctgtcctggaactcactttgtagatcaggctggcttcgagctcataaatccacttgcctctgcctcctgagtgctgggattaaaggagtggctaccacgcccggctagtttttttttttcttataagaacaacatttactggatggtcacttacatattcagaggttcagtcaattattatcaaggcagaagcatggcagtggtccagtagtcatggcactggggaaggagctgagagatctacatcttgctccaaagggaaagaggaatagtctgacttccatgtgtttcagaggagggtttcatttcccacccccacagtgacacacttcctccaacacggccacacctcctaatattgccactcttggatcaagcatattcacaccacaaaggaaagtttagagataaacattaagaaaattaatgaagtcattttatcttatatgctcaacatgactagtacttaaaaccataattttacatgtacaatatttcatggcataacatattttttatatttttattagatattttctttatttatatttcaaatgtgataccctttcccaattcccctccaaaaatcccctatgccttcccctcatagccagctcccaaacccacccactcctgctttctggtcctggcattcccctatactggggcataaaaccttcacaggaccaagtgcctcttctccattgatggccaattaggccatcctctgctacatatgcagctagagccatgagttccaccatgtgttttctttgattggtggtttagttccagggagctctgggggtattggttagttcatattgttcctcctatggggctgcaaaccctttcagccccttgggtattttttctagctccttcattggggaccctgtgctccatccaatggatgagtgagcctccacttttgtatttgtcaggaactggcagagtctctcaggagacaattatatcaggctcctgtcagcaaaatctcgttggcatctgcaatagtgtctgggtttggtggttgtttatgggatggatttctgggtggggcagtctctggattgtcattcctttagtctctgcttccacctttgtctttgtaactccatccatgggtattttgttcccccttcaaagaaggatcaaaatatccacactttagtcttccttcttcttgagtctcatgtgtttttcaaattgtatcttgggtattctgagcttctaggctaatatccacttatcagtgagtgattatcatgtctgttcttttgtgattgagttacctcacttagcatgatatcctccaggtctatccatttgtctaagaatttcataaagtcattgtctttaatagctgcatcgtactcaattgtgtaaatgcaccacattttctttatccattcctctgttgagggacacttggtttttcccagcttctggttattataaataaggctgctatgaacatagtggaacatgtgtccttagtacatgttggaacatcttctgggtatatgcccaggagtggtattgctggatcttctggtggtactatgtccaaatttttggggaaccatcaaactgatttcctgagtggttgtacaagcttgcaatcccacaccagcaatagtggaatgttcatctttgtccaagtccttgccagcatctgctgtcacctgagtttttgatcttagccattcttactggtgtgaggtggaatcttggggttgttttgatttgcatttccctgatgtttaagggttttgaacatttttaggtgcttattagacatttggtattcctcagtttagaaatctttgtttagctctgtaccacatttttgaatagggttatttggttttctggagtctaacttcttgagttctttgtacatattggatattagccctctatcagatttagaattagtaaggatctttccccaaactgttggtggttcttttgtcttattgacagtgtactttgccttagagaagctttgcaattttatgaggtcccatttgtcaattcttgatcttatagtacaagccattggtcttttgttcaggaatttttcccatgtgtccatatgttcaaggcatttccccactttctccactacaagttttagtgtctctggttttatgtggaggtccttgatccacttagatttgagctttgtacaaggagataagaatggatagattcacattcttctacatgctctctgccagttgagctagcaccatttgttgaaaatgctgtcttttttttcccccactggatggtttttagctcttttggccaagatcaagtgaccattggtgtgtgggttcatttcttggtcttcaattctagttcactgacttacctgtttgtcactgtacaaggaccatgcagcttttttcacaattgctctgtagtacagcttgaggtctgggatggtgattctaccagagagattcttttactgttgtgaataatttttgctatcataggatatttttttatttcagatgaatttacaaattgctctttctaactctgtgaacaattgagttggaattttgattgtgattgctttgaatactcaagatataatttacaaaacacatgaaacttaacaaggactactaaagtgcagatacttcgatccttcttagaagggggaacaaaatacccatagatggagttacagagacaaagttcggagcagagactataggaacgaccatccagaggtccacctggggatccatcatgtaaacaaccacccaaaacagacactattgtggatgccaagaagaacttgctgacaggagtctgatatagctgtctcttgagaggctctgccagggcctcagaaagtggaggctcacagccatccattggatggagcacagggtccccaatgaaggagctagagaaagtactcaaggagctgaaggggtttgcagccccataggaggaacaacaatatgaactaaccagtacccccagagctccctgggactaaaccaccaatcaaagaaaacacatggagggacttgaagctcttgctgcatttatagcagaggatggcctagatggtcatcaatgggaggagaggtcaatggtcctgggaaggttccatgccccagtataggggaatgccagggccaggaagcaggagtgggtgggctggggatcagggagggggagatgatagggcattttcagtggggaaactaggaaagaggataacatttaaaatataaataaagaaaatatctaattaaaaaggattacctatgtgcatgggagctcatgagcagcaggggtcactctaaggccaataatccacatagagcgatgagctgtgtgtgaacaggactctgtatcctctgtggtttcctttcttaagtgtattaactgatctgtccagctgtgattgacatgtgatgtctccatgctcaagcccagtaaagattctctgttaaataccttacagacttatgtttacttgtttttatttgcttttcatatttttttaaaaagtcatacaatgtattctaataactcattctcccatctccaatttattctaagtttttcttaactcatccaaccacacactttttaattctgataaagcacccccccccccaaaaaaaaacccaaccaaccaaaaaaaaaaaaagccaaggaatttaaaaggggattgaaagcaaataaaaactaaacaaaaaagtaaaaactacacacacacacacacacacacacacacacacacacacacacacacactcacacacacacacacacaccacacacacacacacccatgcacgaacacacacacacacacacacacacacacacacacacacacacacacacacacatggaatccagtaaaaccacaactctttacccatgatacacaggaaaatataagtcaaacaaacagaatggaagaaggtggtattataaaaatgtctgcacaaataccattaagttcattttcttgttggctaccaactgctaagcctgtctcccttgattaattgtgcttatcatcccctatgaactccattggaggacactaatttttccttctgtctccaggaattgaagtgttgcagaactctcagtagctttatttacctgcacaatacagcctctaatccaaccagtgaaaattaccacatgagagacttccaaatgaaagaacaggtaaagttgtctactggcaagcttagtaatatcatgtaaatgccttagaatttaatgacatatgtcatcctctgaggttaataaatccattttggtgcatatataccctgaactcaccactaacataatacaacaattaaaaaattccaacatggatgcagaggaatccctgagggacatttgttgatttgtgagcacaatataattattttttgggggggaaatgtctgaatgttaactctttaccagtgataatctattctattaatgtgtacataggtagcactaattaaaatcactgtgttatcaggtaatgaaacagaggaagtaggatgctgggaaacagacttttggaaggtcccaagggaaaccacagggacctagtggtgatagattatggtgagagtcctgagagtggtcatagattatagcatatttcatatgcaattgaaaatttcaaagaatgaaaatccttatgaaatatagaaataacaactttacttatgtacatatacttcatagtacaatttttacactgtgcatatttctcctgtaacatctggttcctcctattttcctttattctcctagacaatttcactgatacaatctcatgtttttgtataaatagttgtatataactattaaatacataagctgttaatgagtcttcattaatgtctgtgatttttttattgtcttaattaatactattatctctaattgcatccacattttcaaaagcaatgtaaatttcttactcatttctgttcaaaaacttctgttgttgtatcattaccatgccttagtgataaaatcctttcttgacacatctatagctattgctataatttagttattgatgatcctcctgcaataatcattgataggtaaatattttaagcacttttacttttagtcattttagtgagatttgaagtagtatataacctgttggaaaggcaaatattaattccatatatgtgaaagaagacgctaaaactaaaaacattagccacttttagatatcttctccttcttcttcttcttcttcttcttcttcttcttcttcttcttcttcttcttcttcttcttcttcttcttcttcttttcttcttcttcttctccttctccttctccttctccttctccttctcctcttcctcctccttccttccttccttccttccttccttccttccttccttccttccttccttccttccttccttccttccttccttccttccttccttccttccttccttccttccttcctttctttctttctttctttctttctttctttctttctttctttctttctttctttctttctttctttctttctttctttctttcttctcctcctccttctttttccttctccttccccttcaccttccccttccttcctctttcccttccccttctccttctcctcaatctacaatctgttaacatattaacatgtcccagagtagagcaacagactcaggtcaaacatctactgagaaatttgcccatgtagttaacatctacagcatctgtctaggggttacaaaaagtctatgggatacaattcctcagaaaggaataggatttggacctgagcatactgctgcctaacacatgaaatggcagttcttctccagctggactaggtccttaactaagaaatgcactgctcatgaatatgcaaattacccaagtctatggcagtaaatacagagatgtccacaccctgaagacaacctatgaacaatgttctctccacagtccctgaagacactgattctaggaccgaagttcctattccgaagttcctattctctagaaagtataggaacttctcgcgcgtctggcctccgaggcctccgcgccgggttttggcgcctcccgcgggcgcccccctcctcacggcgagcgctgccacgtcagacgaagggcgcagcgagcgtcctgatccttccgcccggacgctcaggacagcggcccgctgctcataagactcggccttagaaccccagtatcagcagaaggacattttaggacgggacttgggtgactctagggcactggttttctttccagagagcggaacaggcgaggaaaagtagtcccttctcggcgattctgcggagggatctccgtggggcggtgaacgccgatgattatataaggacgcgccgggtgtggcacagctagttccgtcgcagccgggatttgggtcgcggttcttgtttgtggatcgctgtgatcgtcacttggtgagtagcgggctgctgggctggccggggctttcgtggccgccgggccgctcggtgggacggaagcgtgtggagagaccgccaagggctgtagtctgggtccgcgagcaaggttgccctgaactgggggttggggggagcgcagcaaaatggcggctgttcccgagtcttgaatggaagacgcttgtgaggcgggctgtgaggtcgttgaaacaaggtggggggcatggtgggcggcaagaacccaaggtcttgaggccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctttggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacgtgttgacaattaatcatcggcatagtatatcggcatagtataatacgacaaggtgaggaactaaaccatgggatcggccattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgatgatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgaggggatccgctgtaagtctgcagaaattgatgatctattaaacaataaagatgtccactaaaatggaagtttttcctgtcatactttgttaagaagggtgagaacagagtacctacattttgaatggaaggattggagctacgggggtgggggtggggtgggattagataaatgcctgctctttactgaaggctctttactattgctttatgataatgtttcatagttggatatcataatttaaacaagcaaaaccaaattaagggccagctcattcctcccactcatgatctatagatctatagatctctcgtgggatcattgtttttctcttgattcccactttgtggttctaagtactgtggtttccaaatgtgtcagtttcatagcctgaagaacgagatcagcagcctctgttccacatacacttcattctcagtattgttttgccaagttctaattccatcagacctcgacctgcagcccctagagaagttcctattccgaagttcctattctctagaaagtataggaacttcctagggtttcaccggttaaatggcatgtcccctgttagtggttcatgcaagcagaagctgtatcctgtttgacaaagattcagcatgaaaggtcctgctacctaaaaaaaaatagacagatgagatttaattaacctaaataatttttttcacaacaacagagtgaatacgcaatttacagaatgacagaaaacttttgcacactttgcctgtgacagggaactaatatgaagaatttgcaaggaactcaaacaactctacaacaacaacagcaacaagaaccaaataactccgttaaaatgagcaaaggacatgagtagacattttcaaaagaacacatagaaatggataataaatatataaacaatactcaacatcactaaccatcagggaaatgcaaattaaaaccacaataagatatcatcttccaccagtcacaatgactattactaaaaactcaaataatatcagatgttgctgaggatgggaaatgaaggcaactcttagacattgttgatgaggatgtagatgagtacaacctctgtggaaaatggtatggagatttcccagaaaactagaaatagaactgtcatttggtccagcaatcccactactgggtaactacccaaaggaaaataaactattatttcaaaaagatacccaccttctatgcttaccataaaactactctcaatagcacatatgtcaaactgagtgtctgccaaccgatgattttataaaagaatatagcatgtatgcacaattcaatactagtcagccacaataaggaatgaaactgtgtcttttgcagcaagatgcatagaagtgggggacaatataattagtgaactaactcacaaacagaatgtcacatgtcacacattattacttgtaagtgggaggtaaacagcgtgtacacaaggatttgtagagagaaattacacacattggagacttacaaggatgggcgggcagaaggtgggagcatgatgagtcattacataacaggcacaatataaaataattaagaattgaccaatgatcttaaaattaaaatgtagaatatgatcaataaatgaacttgatattagttgacctcattaaatttaaaaactttttctactcaaatgactgtaagaaaatgaatgcccggttacagatgagaaactgtttgcgagtcaaataaccaccaatgtaactataataagaaacttcagaactcaactgtgaataaaaaagaaacaactgatggataaattaggcaagggtttctacagacatttcgtcaaagaagatgtgcagatgacactgaagcatataaacaggatctcaacaggattttccgttagagaaattcaaatcaagcccgcaaagagacaccactgtacactttttaaaatggctgaaattaagaagaaatacagataacatcaatgctggtgagcataccaggttgctagaggctaaaacattgctaacaggaatgcaaaatgaaacagatactcaggaaaataatttttagttttctctaaaatcaaacatacccttaacacctgaatatttgcatcagagaaaaacaatcttacattcacgcataacttctattcaaatattcaagatatcgtgtgtatgtgtgttagaaagtaaaaataacataaatgtctcaaaatttgaataggtgaagaactaggaagcatctataaattgaataccaccagcaataaaaaaataacaagtgaccgatacataaactattacaggtgaactccagacattgtgctaagtgagagaagccagtctcaaagatcaaagggacacagctgtaagcaccacggtcatcctcaggtgtcagtggtttgggctggactttctgtgtctctttcctgaccagacccagatattgagctccaccacttgcagatggaaaatcctattttcaaccatgcagtgaggtttgaactgcttcacagactgaacgaaacaaacacgggctcctttgaacagcgtccggcatttgttccaaccacaagagaacgtccctcagctctcccacctcctcggttctctcctgcaagccagcagccctgcagtttagcctgcatctcccgtgcatccacccatctccctccaagcaccttcccccacaccctccactgtttctgagagcacaggcaggctttgaacttttccgcattctgttgttattgaagttaggatgtttaggaccaacttaaggatcatattttatgactgaattccagtgccccttctctcctgggacagagtgcataaccaagtttctgcaggtggagacgaagttgagcttttttcttcctcagcctaggagatgagcgctaattggagggttggcagaagcttcccaccatcccagcactttggttctggtggggcggaatcggtgccatagggcagagctagaaaccgcggactgaatgttcccagtggcactggacccagggcagagcctccatccacgagtggggctctatggaagaagtgagtctctggctctcagtagctctcgtccagcactgaacctcagcatcatgtgctgtgtgcagggtcagagggccaacgtactggcccctgggaaagcgtttcctctggtgggagttggtagaaggtgtcctgtcttcttggctgcatctgtccgcagtggagtttacatcatgctgagctgggatgtggaaggaaggaagagcatcttagatcaaatatgatgactggccttactgagttttctagattttcctgaataaatgtttcttcactcactgtgtgctgttagagtctttccaaacctgtaatttcccaaaataattttcactggtctcatgagggcatggattcattgagcccctcatgctgtcaaagagaaatagaactgtttttttttttcacttcatagcgaacatccatgggttatcaaataatgggctggcttttcttccaacactttacagacaccatcaattttcttcttgcttataaggttttaaccagaagaatgctgtcatggtcttttctgttcttttggaaggaatgccccctctactcacctccacttgtctgcctgtatttctatttgtctttggttttcaacaattttaataagatttacctaaatgtgtgtggggggagcatggggtgttattctgctgttctgtgttctctgagatgcatggattcaccatttactctgtctccatttttgtgaaaacaattagaaaaaaagtcagtatgagcccagaaacaagcctccctgaagtgggcacaggaccacctgggggcgctcaggacccactgaacacaagagccagccccagggcaggtgcagatgcgggttaagttctggtttcctgtcaaccctgtggcttcctctccataaaacagtttcctttgtggcatatctctggattccttatcctgttcttcctgtgaagtctctgaagaagaaacatttgtcgtaacaagagaaaaactttctcacatgcaccaaaggcagagtcacctacagtcacttactcctgtttctcaatgtcaataagttaccaatgcttctgaagttaatcagctaaatctataaaaggtgcggtgtttaactcagcattacagcccagctcaacagaactccaaaggtcagccagcagcagccaggaaaaagtgcatgctgggcattggggcagagggagttaccatccagtgcaagagaagaaagcccccgtggtggtcattgtcaggactccaatcccacagttccaattgtaggtgatgccaggcaaaggaagagagaccccaccaatggttagtgtggatgtcgagtttgatgtttccacactcacactccaggtgaatatgaaaagatttattagctctatttctgaggtgtctgctgagagcagcacagtcctctcaagaaattacagattggaatttcctcagtagagcaggaaaggaggctggctcagggctttataatgatttggtggtggggtcggcgggggggggggggcgtttctactcaggagaaggagcttgtgtgatttaaacctcacactgacatcacatgagggagcttccatgatttcttactagatttcccatgtgtgggggacaaggatgagggagaataaaccttaattcatcagcatcaaggcaccaaaaataggacctgacactttattctccctagcagcttaagaaaatgagtgaaaaagagagataagagtccacccatgtgctgaaaagcatagctcttggtaaagacgagaaaaaggcactcctacgaagaaggggttgggcagaagctttatgctgaagggtttggctaaagagacataatcaacaggttacaggaggggctactgatgttcatggaggtggtcctcacacatgcatactgaacaaacatgtctgtaacgtatgacccctgttcacttaccagtggagacttagcatttaaattcattccagtcaggccctatgtgcaaacagcagaagcagagacacaaaggtactcagggtgcagcctctgtgaacggccagagccaggccatggtcagcggtctcggattaggagaaagttcctgatatcactgtagtgttcaatcaaagctggggttatggtttgtggaacaggggtcagttcatcagggggtgggctgcaattgtcttcatagtgcttgtctcagtgccggtgcttactgagccactagagaaaaaggtttaattgagcttctttaaaatcaacattttgaattatttatcagacgtttcaaatatgtcatgttgtttagattctattgctggagagttaaggtgatatttggggttttgtaactctgttttttcatacttcctgaattgcttatctgtttgcttttcattagctaaactatcgcttcttcttattttttaattcattctgattttgatgaatatttaattccctttagaatgtgaatataatgtacattgtgtgggtattttgattttggttcttggtttacttagtggcaaagactctgtaagagttccttgtctatagatagccattatttagtggctttctgaaatggtggttttagtaccaaagtactggacttgtgagtaggctcactgccccctgcaggtcctagatagtggaggcctcaggaactgtttctcatttggaatgcctttgtttcagcagattttgtgttgggttgttaagttcaccctccacattagtagatgtccttacagattagagctgactctggtagaagcagttgagtgcatgcttgatatctgtgcacagggagaagctctctgttgcctcaggcgatggactggtctatgaaatgcacagtgacctgagttccctgctcagcccctgagaggtggaccaagctggacacacatgagccaccgagcctggcaagcaaaagcgccagccttgatggaaatggcgagctgagcggcatctactcagtgtggtttcttttgttattaagagctttagtgtggtggctgtttcaaattcccgttgtagtagtaatatactgggtatgtgagcaggcccgtggtcttttgcggggttggaatcaccgaagtaatgagaagctaatctcattttcaactgctgtacactggtggtattgagtttgtatgaggtcatgcagtttgaacgtcaggccagtaggtggtgctcgcaggtaagagccggctatggtggcagcagaagggtttatgctttactggtgattaaagtgggaaacttggcgtgttccagatcttagagaaaagatttttagttatttctcattcaacctgatactacctgaaagtctctcgaatgtaacttttattttgtcgagatgggttctttctatacccattttttatgttttttttgtgaaaggatgttgtttcatcaaatgcgttttcagcatcaattgaaaaaagttatatgtggattaaagatcaaaatgtaaaacctaacactataaaacctctggataataacataggaaacagaatttaggaggtaagaactgacaaaggttttataatgaaaatgctagaagtagttgcaacaaaattgaaaattgacaaatgggacctaagtaaattaaagaacttctgtacagcaaaagacactatcgacagagtaaacaggcaacctacagaatgggaaataaaatatttgcagcctatacatctgacaaaggtccgacacttagtatatacatggaaatttaacaaacatacaagaaataaaaagtgaccaaaggacatgaaaagacacttcaaaaaagacctacatgtggccaacaagcataggaaaaaatgctgaatatcactatcattagagaaatacatatcaaaacctcaatgaggtaccgtctcacatcagtcaggatggctaatcttaaaaaaaaaataacagatttttaaggttacagaaaaaaggggaaatttatacacttttggcgggaatataaatgagttcaaccattgtggaaagcagtgtggtgatccctccaataacctaaaacagaagtttcatttgacccaacaatcctacaactggacatatacctaaaggaatataaacatgtaggttcactgcagcactatccacaatagcatagacatggaatttacctaaatccccatcactggcagaatgatagagaaaaatgtggtacatacaaccatggaatactatgcagctaaggaaagaatgaaactatgtcctttgtaggaacatgatggaactggcagtcaatactcttagaaaactaattcaggaacagaaaaccagatattatatattctcccttatttgttggagataaataaaagcaaatattcttccagggcctgagtcttccttattcaacaagtcattctaaattaagtgttcagcaagttgctgatactcatctaaatattctatttcatctgggccacttacatcactcaaaaagcaatgagagctatatttctaaggggggttctaggataataaatacctgaatagtgagaatatgaaggatatggaaactgggccacttatatcactcaaaaaggaatgagagctatatttataaggggggttctaggataataaatacctgaatagtgagaatatgaaggatatggaaactgggccacttatatcactcaaaaagcaatgaaagctatatttacaaggggggttctaggataataaatatctgaatagtgagaatatgaaggatatggatggtttttttttaactcaatgggcacataactgtgggagatactatattcctatgaagaaggtattcagacttcagagataagtaatgtttcctacattgtgcttgtgacttggaagcagtggattgaagagtgtgataagtgcccagaccaagcagaacagaaatcagcatgtaaagatgatgatctatggatatgatctaaaaccatgtaaatacttcaaataattctatttaatgcagtttgaaataaaacacaaacttattcaaaatacaaattacttggtaattattttgggagctatgagttcaccaagaaactcaaattcctatttctatttcaacccctgattcctactgtcaatgggagggaagtctcagaaccaatcacacatcagacggcaaatctgtcaaccaagagtctttccactgaaggacctgggaggtcaggaccctcaggaaagtgctggggaccctgtcttgggagtgcccagcagatctcagaactctccatgggtcctgctggacactcatgtagggtaacgagtggccaccttttcagtgttaccagtgagctctgagtgttcctaatgggaccaggatgggtctaggtgcctgctcaatgtcagagacagcaatggtcccacaaaaaacccaggtaatctttaggccaataaaatgtgggttcacagtgaggagtgcatcctggggttggggtttgttctgcagcgggaagagcgctgtgcacagaaagcttagaaatggggcaagagatgcttttcctcaggcaggatttagggcttggtctctcagcatcccacacttgtacagctgatgtggcatctgtgttttctttctcatcctagatcaggctttgagctgtgaaataccctgcctcatgcatatgcaaataacctgaggtcttctgagataaatatagatatattggtgccctgagagcatcacataacaaccacattcctcctctgaagaagcccctgggagcacagctcatcaccatggactggacctggaggttcctctttgtggtggcagcagctacaggtaaggggcttcctagtcctaaggctgaggaagggatcctggtttagttaaagaggattttattcacccctgtgtcctctccacaggtgtccagtcccaggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccacggaccaatccacgagcacagcctacatggagctgagcagcctgagatctgaggacacggccgtgtattactgtgcgagagacacagtgtgaaaacccacatcctgagagtgacaaaaaccctgagggagaaggcagctgtgccgggctgaggagatgacagggtttattaggtttaaggctgtttacaaaatgggttatatatttgagaaaaaaagaacagtagaaacaagtacatactcctctaattttaagataaatattccattcaagagtcgtaatataagccaaattcacagagtggaagctcgagcggccgccagtgtgatggatggtacctaactataacggtcctaaggtagcgagggatgacagattctctgttcagtgcactcagggtctgcctccacgagaatcaccatgtcctttctcaagactgtgttctgtgcagtgccctgtcagtggaaatctggagagcatgcttccatgagcttgtgagtagtatatctagtaagccatggctttgtgttaatggtgatgttctacataccagttctctggcttaataatgaggtgatgattctatgttcctgtaacgcttcctcaactgggtcctaagtctttcttcactccatctattcctctaaggaatgatcctgaaaatcccatcacaaactataggagatgggaaccatcaaaaaacacagtgacaaagaggtgggaacgcatcagggttcaggaaccatattttaaaaagatatcgtaaataacttcttaaaagagatatagacaaatctccattaatacggagaccagaggcctaaggctaagaaccaatggtggctcaaggtctcctgctacccgaggagcaaacgtagagcagtttctaatgatttatttaaaatatagaatcaaaagtaccagtttgcaattttgaaagatttatttcagcaatgcaacaacatcaggtggtgccgagtccaacacgtcttatgtcccatgatataaacaaaggccatccagaactgtggactggagttctaccttgtcccctaatgacattcagattttttttccattctctttatcttagaggagacagggggctaactcattttacttgtcctttgcttgttcttgccaagaacgtaaagcagcttgcaagtcttcaaacctaaatatcttagtaactcctacacgagtggcaatgccaaagagcagtgcaacaaagaggaagtaaatacgaccaaagagtattcttaaatacactactggctctaggttctgttttattatgcgcctttgaaccggaggggacccactgtctatgctcccactgtgtccctcttctttgcactttggagggctccaaccaaaatggcaatggcaattccgacgattgttacacactcctctgaaattgcatttttctggggtgcagtcataacccaaacgagataaacttccattgcaagctcctcgatcacagaacttaccccttgaacacggggtaccatgtctcaccaatccagcatctgctgtttctgtcccacgatgttcatcaagcccaaagcaggtaaccccagagataaccgattgatggaatgaaacatgttcttgcaaaaatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccctcttctgagcatggtgtcccatcttgcagataagtgtcatctgggcaaatgaacttagagccactacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcattgttatctactttgaagtttccacaaaacttataagtcaatgatgtattataataaacatgacggtcatagaaaagacatggcatcagatcaggagtattaagtatgttgcttatctctgcaagggaacaattgctgaaagcatctgttaattgaggatttttgaacatgatgcaggtgttccttctctggcagatacagtacccctcatcatgttttaggcctaaactccttccaacacgattggttattataatagataaaaataaaggatttcgaccatgttgaccaagacaaattagggctgagggagaacatatactcctctcagctggattaacagcatcatctcctggcgaattcttgttaattatagctcctgcatcaggcctaaaatgagcataaaatactctctcatagaaagtatgagcctgccctcctggaactcgaaaatcttgtgaaaatggatcagcctcggtatacacagtcatgagaaagacatagtaccgcatatgaagattggtcagataggtgtccattaaactaatgactttaaacaaatactcaacagtagatgaaagtttgtcacctccagaagcactatatacagaatgggttgcttgaaagtggccttttatagcagctggatgtgtagcgtaattcttactagatagtctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggttatccaactttatgacccctgacaggcccccataacaagtatccacagtgaccatggattgcaggatcccctccaggtagccaatatagtaacaatctacaggaaaaaaggggtactccatctgtaaggctccttggtcatcttgagttgtcagcaacaagtgtctgggccaaatgagtgtctttctccgcaggtggatgatatgtctctggccccgaaaacgcaagctatacgagagcagtctttgtgcttgaagtcctttggtatggtagatctccttccgaggaataaccacctccgatgagatgtaacgccaagtgggatggccttgagaacaccagactggaaccaggaggagcagccagagtgcaaatagcaagaggaggaccctggggaccacaggtctttccactagcctcatgccccaggtcagagataacatcctgggtggagctaactccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttttcacagttgttctaacttcttgttttgttttgtttgtttgtttgtttgaaagttagaagtaaatactgtctatattagccttttagctataaatgattgtttttatttcttctaatcatgttttgtttgagttttggttaaactatttacaaatgagttttttttttccttttgggtgttgctcgaaagtttggagctttctgttaatattgtgttgttgtttctccaatattattagacctgagaattctacctgggtacctgtgaactccagaatttttaaaaattccatctcttgggaacattatctctgaccccgtctgaggccgaagtggctgtccccctccaacctttagtatctttctttcctgactattgggatttcttcaagcaatcaggctgatgggttctcagcagtgagaccagtagactgtcggtatgaacgtcgaagagtctgccacacactccgggttcatcaacagtgctttcgcgtctcttacttttgtagaaggaaatgcagcctctgagttttctccaagaaatcattgatgaaagggtgaaaagatgggtatcacccggagttcatgacaagccctggctcagacacgtgagcaaggtctacagccccaaagataggctgccctgcaacatgtatttataagataggagaaaaaaatgggtagttggagggttgatcaacttacttcctctcaaacatatatatctcatctaagtgtgcaggggaaaactctgtagaactactgggatacctgctcacccccaggagcctcatgaataagtctctgcttctgccttgtagccatgagcattactgcacctgatacccctgcagcttcctagggaagagggaggaagtgacttggcccctgtctggttaaggtaagaggagataaatcccttctcattgattagggtgagaggggtcatgtgctctatcattggtgacccagttgggacatgggtttataccaaagtcatcactctgaggttctgtgtaccaccaggctgaactcccatatcctacatggacataggacaacaccaagcagaaggaggttttaggactaaactgaaggacagagatgcggtttctaaacaactagggagtgccagggccagcctctctaaccactataggacactgtggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaagggagggagggagagagagagaaggctaagtctttccatacctgggtcccaatacctcttataacccaagcacatggtttcacatatcacaatgcggttgggatatagataactgtaaatacttgtgaaaataatggggctgagatctggggttttcatgatagtttcaaagtcaccgtactgactaaaaccttccactggcccatctccagcttcctaatctgagggtatcaaatttcccactaagtgtgtttagaaagatctccacctttttgcccttgtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaaaggtaggcatgtagaagctgaagcatctcacctcattccaagcaccctcagtctctaaatgtgcccccttgtttccagaagtgcaacctcaagcatcttttattcattcatcttagagggccacatgtgctgtagtgttataagatgaaatttaaagcattaattattcctaacaagccaattaaacaagccaaaaacattcatcagtcattcccatggaacctctgaagcatcttcctgctctaaccttgggttttccagggctgctctgggatcacaggagctgtcctgtctaccagccatataaaggcagacctatcagaattacaccagacttctcaccatagactataaaagccagaatatcctggacagatgttatacagaaactaagagaacacaaatgccagcccaggctactatacccagcaaaactctcaattaccatcgatgaagaaaccaagatattccattacaagtccaaatttacacaatatctttccataaatccagccctacaaaggatagcagatggaaaactccaacacaggtaggaaaactacaccctagaaagagcactaaagtaatcatctttcaacacactcaaaagaagataaccacacaaacataattccacctctaacaacaaaaataaagtaggcaacaatcactattccttaatatctcttttaacatcaatggactcaattctccaataaaaagacatagactaacagactgaatacataaacaggacacagcattttgctgcataaagcaaacacagcgttacttttttttttctaaatgacattttttattagatattgtctttattgacatttcaaatgttatcccctttcctggtttaccctctgaaatcccctatctcctccccctccccctgctcaccaatccacccactcccacttccaggccctggcaatcccctatatttgggcatagagccttcacaggaccaaggtactctccttgcattgatgaccaactagtccattctctgctacaaatgcagctagatctatgagtcccaccatgttttcttttgttggtggtttcatgccagggagctcttggagtactgattggttcatattgttgttctccctatggggttacaaaacccttcaacttcttgggtcctttctctggctgcctcattggggaccttgtgcgaagtccaatggatgactgtgagcatccacttctgtatttgccaggcactggcagagcctctcagaagacagctatatcaagatcctggcagcaagctcttgttggtatccacaaaagtgtctggtggttgtctatgggatggatccccaaaggggcagtctctggatggtcattccttcagtctctgttccacactttgtctctttaactccttccatgactattttattcctccctctaagaaggaccgaagtattcatactttggtcttccttcttgaaattcatgtgttttgtgaattgtatctttgatattccgaacttctgggctaatatccacttatcagtgagtgaatatcatgtgtgttcttatgtgattgagttacctcactcaggatgatatcctccagaaccatccatttgtctaagaatttaatgaattcattgtttttaatagctgaggagtactccattgtgtaaatgtaccacattttctgtacccattgttctcttgagggacatctgggttctttaaagcttctggacattaaatataaggctgctatggaaatagtggagaatgtgtccttattacatgttggagcatcttctgggtatatgcccaggagtgctattgctggatcctctgatagtactatgtccaattttctgaggaactgccaaactgatttacagagtggttgtaccagcttgcaattccaccagcaatggagaaatgttccccttcctccacatcctcaccaacatctgctgtcacctcaatttgttcttagtgattcagacaggtgtgaggtggaatatcagggttgtttggcatttccctgatgactagtgatattgaaaaaaattttaagtgtttctcagccattcagtattcttcagttgagaattcactgtttagctctgtactcaggtttttttaatagggttatttggttttctggagtctaacgtcttgaattctttctatatattggatattagccctctgtcatatttaggattggtaaagatctttcccaatatgttggctgcctttttgtgtcctttgccttacagaacctttttaattttatgaggtcccatttgctagttcttcattttacagcacaagccattggtgttctgttcaaaaatctttccccctgaaccctatcttcgaggatcttccccactttctcctctataagtttcagtgtctctattattgtgctgagggcgatcgcgatgtgggaacgcttcagtgttcaggaaccatatgatttatttaaaatatagaatcaaaagtaccaatttgcagttttgaaagatttattccagtgtaagcattagcaatgcaccaacatcaggtgatttctgaatccaacacgtcttatgtcctcatgatattaaaaaaaaaaaaaggccatccagaactgtgaacttgagttctaccttgttccctactgacattcagattttcttttttgcattctctttatcttacaggagacaggaggggagggctaactcattttactttggcttgtcccttgctggtccttgcccagaacgtaaagtagcttgcaagtcttcaaatctaaaaatcttagtaactcctacacgagtggcaatgccaaagagcagtgcaacaaagaggaagtaaatacgaccaaagagtattcttaaatacaccactggctcttgtttttgttttattgtgtgcctttgaactggaggggacccactgtctatgctcccacttagtccctcttctttgcactctggaggcttccaaccaaaatgacaatggcaattccgatgattgttacacactcctctaaaactgcatttttctggggtgcagtcataacccaaatgagataaacttccactgcaagctccttgatcacagaacttacttttggagcagggggtaccatgtctcaccattccagcatctgttgtttctgtcccacgatgttcatcaagcccaaagcaggtaaacccagagataatcgattgatggaatgaaacatgttcttgcaaatatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccatcttctgagcatggtgtcccatcttgcagataagtgtcatctgggcaaatgtatttagtcccattacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcatcgttatctactttgaagtttccacaaaacttataagtcaatgatgtattataataaacatgacggtcatagaaaagacatggcatcagaccaggagtattaagtatgttgcttatctctgcaagggaacaattgctgaaagcatctgttaattgaggatgtctgaacataatgcaggtgttccttctctggcagacacagtacccctcatcatattttaagcctaaactccttccaacacgattggttattataggagataaaaataaaggatttcgatcatatttaccaatacaaattagggctaaggaagaacatatactcctctcagctggattaacctggttatcttgtggcccatacttattaagtaaaactcctgcatcaggcttaaatttattataaaagactgacacatagtaattataagccgaccctcctggaactgcaaactcaagtcgaaatggatcagaattggtgtacacagtcatgagaaagacatagtaccgcatatgaagattggtcagataggtgtccattaaactaatgacttgaaacaaatacccaacagtagatgaaagtttgtcacctgcagcagaattatatacagaattggttgcttgaaagtggccttttatagcagctggatgtgtagcgtagttcttactagatattctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggtcatctaacttcatgacccctgacaggcccccataacaagtatccacagtgaccatggattgtgggatcccctccaggtagccaatatagtaacaatctacaggaaaaaaggggtaatccatctgtaaggctccttggtcatcttgagttgtcagcaacaagtgtctgggccaaatgagtgtctttctccgcaggtggatgatatgtctctggccccgaaaatgcaagctatatgagagcagtctttgtgcttgaagtcctttggtatggtagatctccttccgaggaataaccacctccgatgagatgtaacgccaagtaggatggccttgagaacaccagactggaaccaggaggagcagccagagtgcaaatagcaagaggaggaccctggggaccacaggtctttccactagcctcatgccccaggtcagagataacatcctgggtggagctaaatccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttctcacagttgttctaatttcttgttttgttttgtttgtttgtttgaacgttagtagtaaatactgtctatattagccttttagctataaatgattgtttttatttcttctaatcatattttgtttgagttttggttaaactatttacaaatgagttttttttttttccttttgggtgttgctcgaaagtttggagctttctgttaatattgtgttgttatttttccaatattattagacctgagaattctatctgggtacctgtgaactctagaatttttaaaaattccatctcttgggaacattacctctgaccccgtctgaggccgaagtggctgtccccctccaacctttagtatctttctttcctgactattgggatttcttcaagcaatcaggctgatgggttctcagcagtgagaccagtagactgccggtatgaacgtcgaagagactgccacacactccaggttcatcaacagtgctttcgcgtctcttacttttgtagaaggaaaagcagcctctgagttatctccaagaaatcattaatgaaagagttaaaagatgggtatcacccggagttcatgacaagccctggctcagacacgtgagcaaggtctacagccccaaagataggctgccctgcaacatgtatttataagatagaagaaaaaaatgggtggttggagggttgatcaacttacttcctctcaaacatatatatctcatctaagtgtgcaggggaaaactctgtaggactactgggattgttattatcattattattattattattattattattattattattattattattaacttaaggcattttattagatattttcttcatttagttttcaaatgttatccccggaacctcctatactctctccctgccctgctccccaacccacccactcctacatcctggccctggcattcccctatactgtggcagatgatcttcgtaagaccaagagcctttcctcccattgatggcctactaggctatcctcttttacatatgcaactagagtcacagctctggggaggtattgcttagttcatattgtttttcctcctatagggttgcagatccctttagctccttgggtactttctctagctcctccattgggggccctgtgttccatccaatagatgactgtgagcatccacttctgtatttgccaggtattggcatggatcttactgcaccttctgaactctctaagcagctttcctggtcacctccaggagcctcatgaataagtctctgcttcccccttgtggctatgagcattactgcacctgatacaccctgcagcttcctagggaagagggaggaagtggcttggcccctgtctggttaaggtaagaggagataaatcccttctcatgaattagggtgagaagggtcatgtgctctatcattggtgaccaacttggggacatgggcttatacagtcatcactctgaggctctgtgtaccaccagactgaactcccatatcctacatgcacataggacaacaccaagtagaaggaggttttaggactaaactgaaggacagagatggggtttctaaacaactagggagtgccagggccagcctctctaaccactataggacactatggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaaaggagggagggagagagagagaaggctaagtctttccatacctgggtcccaatacctcttataacccaagcacatggtttcagatatcacaatgcggttgggatatagataactgtaaatacttgtgaaaataatggggctgagatctggggttttcatgatagtttcaaagtcactgtactgactaaaaccttccactggcccatctccagcttgttaatctgagggtatcaaatttcccactaagtgtgtttagaaagatctccacctttttgccctagtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaagggtaggcatgtagaagctgaggcatctcatctcactctaagcaccctcagtctctaaatgtgcccctttgtttccagcagttcagcctcaagcatcttttattcactcgtcttagagggacacatgtgctgtagtgttataagatgaaatttaaagcattagttattcccaacaagccaattaaacaagccaaaaacattcatcagtcattcccatggaacctctgaagcatcttcctgctctaaccttgagtttcctagggctgctgtgggatcacaggagctgtcctgtttaccagcctatcctgtcccacgggattcagttattagtgggtgcgagggggaccgcaaacctggaagaaaatgggattggaagagaaaagagaaacgaagaccaagtagatcttttcctatcaaggtcttcgtttattaggctgaggtgcctggtgtaaagcatgcatcgcggggaataggaaggggtcgagggggaattttacaaagaacaaagaagcgggcatctgctgacatgagggccgaagtcaggctccaggcagcggacactctgcatcttatctctggaacatagatcctccttgacagccttggggtgtcaggccaggctcaggtgtaactcatgtccttggatggcatgggagttcaggaagagatagggaagaggggactataattcagcttttacagcctcaggtgccaggaaggcaacagggaggagggagtgactacaggctcctagcacgaggccatttggcctgtcagggtgggagattgtgaagggctcactttctcatggtatggtctctgacaccagccagaaaaaaaaaaaatctccagtcaatctacagaaaggcagaaatatggagaaccttctagaagaacagcaacccttgactgactctgcagggcagtctaagcacacaggttcctctgagcccagtccctggctgtattcactcacacagggcccagcagtctggagatgcctgcagcaggaaggttctcactgtacctcagtctcacagctcagtcactttgtagtctccccacagcaaatcacaaccaatgcagttgtcacccttgaggccattcctcagtgacgcctgggaaacactgtccatttgccctgctcatatgctgtctcagctcacataaattccctccaagctcctttacagaaacaaccaattgacatacaaattaaagtaatatgaagctctgtcctgtaccaattcctagaacacctcagctgctaaaatctaactgtgcaatacagagaactacctagataatacctaactccaatcttgaggtatctgttgaagaggctttcagctatgaattaccaagagggatgcctgtgtctcctacatcttaaggcatctttctgaagctcacactacccttcacagcgccacagcagcagggagatctgtatctcttcctctccacaagagggcagaattcgggtgtcaactgtgacaaccctccagcattaatttctattagtagatattttctttacttacatttcaaatgttatccccttccccagtttttcctccctgaaaccccctatcccatcacccatctccctgctcaccaacccacccattccataagaaccaatcagtaccccacccccccagagctcccagggactaaaccaggaaccaaagagtacacatggaaggacccatagctccagctgcataggtagcactactttgaaaagggggaagatgatgaaatcattactgtgggggaaatgcaaggaagattccaacacatctaggcatctatgaagattttaagtcttcaaaatccaaaaccaccacaaaatttaaaaaaaaaaaaagtagattctaaatgcagtcacctgcaccaggtgcctggggaatcactcagcagccctagactgagaaagcttggagaaagtagaaatagagaaagtgtacagccagtatcctctagctactcacatccaaacagggcctcctgactgctctgagcctgtcctaagaacagcaatgatgccacagaaatttttagagtgagccctgaaggaacttgaggctgatatgagcaagccagtcccagaggaaaggaaaacccatagagagaaaacaggtgagttagtgcattaaaggggctgagcagggagttctcatcgctccccagcaccagaaataagagcctctccggagctgctgggacatggaatgcagatgattcggaccatcagccccacagagacctttcccactctggctcagaaagaggcactggaccacagttggagaggagaatcgaaagctgatatctctgtattcacttagcctgttacccacccatgcacccaagtccaaggtgggagaaacactgagggtctaaacacagccccagagcaactgccagtattaaataccagatttcagaagatgggaaatcacctctctggtcatttttgggacatgtaaactgtaacaggaaacataggaccaatttaagatggagcagtcctatatccctaacccagttgtaaataaaacattcaagagtgccatcagacaccacagtggtacaggagagatgagtgtacctagtgcatcaagagttccctcactagataaaccaagatgtagccccaggaccacccaggcacctaccaggactcccctccagaggtctgagccagttagctctagttcattctatgtttcagaccaaaacatcagaaacaacagcatctccactgcagatgaacccctaagccatacagtgtacccaaaggcagcaccacagatggggaatgtgggggcgaagaagcttgtatcacattaagagtgttgcccaatgactatttgctatcttcacagtaagatgggcactgatcccacccaccaaaacatagtaggacaaggacccttaaataacatctgtcaaggggagctgtcaaatagccactgagctgagatggctcatacggggtgatatagaaaaacaggccaaagaacctcctgtgttgcaagcacaaatgggaagctgtgaatctccactaccttacaagaaaactgtaccaatctgcaagaacaggggatacacagctttccacactgtgtaggaaggcattggactctcagatcatccaaggactagggctaaagtggccatgtgtgggaaatacatccactttataaacctaccttgtatccacatcacacatggagcatctgctcctggtccctacctcatgtgggtgctgcggtgctgtacattgagtctgggggcatgagtgtgcccggtaaattccttatcactcagatgaatttccagtccacactcatcaccttggagtaggaattttaaaagttagtgtagatataagtaaagagagtcaggagggggggctgaaaggcagacctgcagaaattctccagagggtagagctcagaagcagcaagcaaaacttgggctaacagaagagcaaacacagagctcaggcagaactacctggcaatgcgactgggcacactgaaagcactgggcatcagcactgagccccaaatatgcactcaggatcctctgcataataatgtaacataacaggaaggttagaacaggccaaaagaggaaacagaacaaatgcccctaaccaaagaagtataaacaaattgggaagagtaaagaaggattgtaaggattgagtaccacacagaacatgctcttaatggcctcaatgctgaagctaggaagaactaagttaaaagaaacatgttcaacgggattccctgtcactggacttcacaacaagcaaaattcaatctttctgttaaggagatgagaagagaatatctgaaccttgtgttgacagtgccccaccccgactgtcaggctgtgggaaatgccagagcaatcactaggaacacacaaggatgagggagacgagggttaggacacaaccatcatgatatcccacaagtatggaagagcaagaacttgtagagagcagagaatggcagacaaagcagcatatacataagtagatggccagactatacaggaaagatctacatagcctgtgaggctttctgacagaaaagggcaggcatgtctcaaagcacaatgcctggcttgggacactgtctgccctggatcctctcactccacatgtaaggagctcacagcaaaaccacacagccttccacaagaggagaagaaaaggtagcttgtcagtgaggaagtcccccagagacagaccattccagtagttcttatcattcctcccaaagcagccaccatccaggcactgagagaccaaaggctgttgggaggtcagcctagaggcaggctcagacctttcttgctccctaggaccttcctgaaaagatagaagcacagaagtgaataatctggacctcaactcaggatgacaactgaaactcaaccgtgctgcctgggcccccaatgctctctacacctgcaggcgcgccggagcaggggatccttagatattggttggggttatctcaccttaggtctgaatatggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccacccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggccagggtctagtgcaggtgcccaggacaagaaagattgtgaatgcaggaatgactgggccacacccctcccgtgcacgccccctcttgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactctacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactgtctcctggcccctgctggaggccgcgccagagaggggagcagccgccccgaacctaggtcctgctcagctcacacgacccccagcacccagagcacaacggagtccccattgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgcccctgtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccccggtcctcactaggcctcagtcccggctgcgggaatgcagccaccacaggcacaccaggcagcccagacccagccagcctgcagtgcccaagcccacattctggagcagagcaggctgtgtctgggagagtctgggctccccaccgcccccccgcacaccccacccacccctgtccaggccctatgcaggagggtcagagccccccatggggtatggacttagggtctcactcacgtggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgttcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccccgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatacccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcacaacaggtgtttctcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaacagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacccgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaaccttctgccacagccctccctgtggggcaccgccgcgtgccatgttaggattttgactgaggacacagcaccatgggtatggtggctaccgcagcagtgcagcccgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggctggcccacattaccatttgctgccatccggccaacagtcccagaagcccctccctcaaggctgggccacatgtgtggaccctgagagccccccatgtctgagtaggggcaccaggaaggtggggctggccctgtgcactgtccctgcccctgtggtccctggcctgcctggccctgacacctgggcctctcctgggtcatttccaagacagaagacattcccaggacagctggagctgggagtccatcatcctgcctggccgtcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccaccagctgcaccagaccccgtcatgacagatgccccgattccaacagccaattcctggggccaggaatcgctgtagacaccagcctccttccaacacctcctgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaataccactcatggagcccccagccccaggtacagctgtagagagagtctctgaggcccctaagaagtagccatgcccagttctgccgggaccctcggccaggctgacaggagtggacgctggagctgggcccatactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccacggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtccttgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcaccccccaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccctctgctctcctctcatcaccccatgggaatccagaatccccaggaagccatcaggaagggctgagggaggaagtggggccactgcaccaccaggcaggaggctctgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcctatctctctcacccacggactcgcccacctcctcttcaccctggccacacgtcgtccacaccatcctaagtcccacctacaccagagccggcacagccagtgcagacagaggctggggtgcaggggggccgactgggcagcttcggggagggaggaatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagccgctcccacacaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgcgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccacggcaccctgccatgtcctgcatttctggaagaacaagggcaggctgaagggggtccaggaccaggagatgggtccgctctacccagagaaggagccaggcaggacacaagccccctccccattgaggctgacctgcccagagggtcctgggcccacccaacacaccggggcggaatgtgtgcaggcctcggtctctgtgggtgttccgctagctggggctcacagtgctcaccccacacctaaaacgagccacagcctccggagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacggtgtccccactggatgggaggacaagggccgggggctccggcgggtcggggcaggggcttgatggcttccttctgccgtggccccattgcccctggctggagttgacccttctgacaagtgtcctcagagagtcagggatcagtggcacctcccaacatcaaccccacgcagcccaggcacaaaccccacatccagggccaactccaggaacagagacaccccaataccctgggggaccccgaccctgatgactcccgtcccatctctgtccctcacttggggcctgctgcggggcgagcacttgggagcaaactcaggcttaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatgcacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgcgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggcacatgtgtggacactgagagccctcatatctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggcctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggtcatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagacagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggagacactgtgcatgtctggtacctaagcagccccccacgtccccagtcctgggggcccctggctcagctgtctgggccctccctgctccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggcaaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcgggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccttggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaacaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgtacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacgattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcccgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccacttcacctgcttctcctggggctctcaaggtcactgttgtctgtactctgccctctgtggggagggttccctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcgccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacccagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggatcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccggcctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgcccagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccccgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcagcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccataccatagggacagagaccagccgctaacatcccgagcccctcactggcggccccagaacaccccgtggaaagagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctgggactgaggggctgggggagcgtctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctcagcagggccttttgctgtttctgctttcctgtgcagagagttccataaactggtattcaagatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggagaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgaccggactcgcagggtttatgcacacttctcggctcggagctctccaggagcacaagagccaggcccgagggtttgtgcccagaccctcggcctctagggacacccgggccatcttagccgatgggctgatgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctcccttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggctctctccttatggttcccccacctggctcctgccgggacccttggggtgtggacagaaaggacgcctgcctaattggcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccgctgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcacccaccgacccgcccacctcctctccaccctggccacacgtcgtccacaccatcctgagtcccacctacaccagagccagcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagattctgtgcaggaccctctcacagtggaatacctccacagcggctcaggccagatacaaaagcccctcagtgagccctccactgcagtgcagggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagacctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcccttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaaaaagacaaagaaatttgtttttttgaataaagacaaatttcatcacacgaagataaagatgcaaagctccagacaggaaggcacggacagcacagtgaagcccggagcgggcgctggggggccaggggcatggcgggggtgccagcgtctctcggttcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgttgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagaaaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagccgagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttttgtttttagacggagttttgctccagcccaggctggagtgcaatggcacaatctcagctcactgcaacttccacctcccgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaagacatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactggcataaaaacagacacagagacaaacagaacaaaatttaaaaacccagaaataaatccacacacctacagcaaattcatttttgacaaagttgccaagaacatactctggggaatagataatgatatctcttcaataaatagtgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttgctacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataagaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccatcctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcctccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtaagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcaggggcacctcccctgcccccagacaccctgtgcccgtcagttcatccccagcagaggccctcaccaggcacacccccatgctcacacctggccccaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttttggggggaaataagggtgctgggtctcctgccaagagagccccggagcagcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcaggtaagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctctagactgagcattgcagactaatcttggatatttgtccctgagggagccggctgagagaagttgggaaataaactgtctagggatctcagagcctttaggacagattatctccacatctttgaaaaactaagaatctgtgtgatggtgttggtggagtccctggatgatgggatagggactttggaggctcatttgagggagatgctaaaacaatcctatggctggagggatagttggggctgtagttggagattttcagtttttagaataaaagtattagctgcggaatatacttcaggaccacctctgtgacagcatttatacagtatccgatgcatagggacaaagagtggagtggggcactttctttagatttgtgaggaatgttccacactagattgtttaaaacttcatttgttggaaggagagctgtcttagtgattgagtcaagggagaaaggcatctagcctcggtctcaaaagggtagttgctgtctagagaggtctggtggagcctgcaaaagtccagctttcaaaggaacacagaagtatgtgtatggaatattagaagatgttgcttttactcttaagttggttcctaggaaaaatagttaaatactgtgactttaaaatgtgagagggttttcaagtactcatttttttaaatgtccaaaattcttgtcaatcagtttgaggtcttgtttgtgtagaactgatattacttaaagtttaaccgaggaatgggagtgaggctctctcataacctattcagaactgacttttaacaataataaattaagtttcaaatatttttaaatgaattgagcaatgttgagttggagtcaagatggccgatcagaaccagaacacctgcagcagctggcaggaagcaggtcatgtggcaaggctatttggggaagggaaaataaaaccactaggtaaacttgtagctgtggtttgaagaagtggttttgaaacactctgtccagccccaccaaaccgaaagtccaggctgagcaaaacaccacctgggtaatttgcatttctaaaataagttgaggattcagccgaaactggagaggtcctcttttaacttattgagttcaaccttttaattttagcttgagtagttctagtttccccaaacttaagtttatcgacttctaaaatgtatttagaattcattttcaaaattaggttatgtaagaaattgaaggactttagtgtctttaatttctaatatatttagaaaacttcttaaaattactctattattcttccctctgattattggtctccattcaattcttttccaatacccgaagcatttacagtgactttgttcatgatcttttttagttgtttgttttgccttactattaagactttgacattctggtcaaaacggcttcacaaatctttttcaagaccactttctgagtattcattttaggagaaagactttttttttaaatgaatgcaattatctagacttatttcagttgaacatgctggttggtggttgagaggacactcagtcagtcagtgacgtgaagggcttctaagccagtccacatgctctgtgtgaactccctctggccctgcttattgttgaatgggccaaaggtctgagaccaggctgctgctgggtaggcctggactttgggtctcccacccagacctgggaatgtatggttgtggcttctgccacccatccacctggctgctcatggaccagccagcctcggtggctttgaaggaacaattccacacaaagactctggacctctccgaaaccaggcaccgcaaatggtaagccagaggcagccacagctgtggctgctgctcttaaagcttgtaaactgtttctgcttaagagggactgagtcttcagtcattgctttagggggagaaagagacatttgtgtgtcttttgagtaccgttgtctgggtcactcacatttaactttccttgaaaaactagtaaaagaaaaatgttgcctgttaaccaataatcatagagctcatggtactttgaggaaatcttagaaagcgtgtatacaattgtctggaattatttcagttaagtgtattagttgaggtactgatgctgtctctacttcagttatacatgtgggtttgaattttgaatctattctggctcttcttaagcagaaaatttagataaaatggatacctcagtggtttttaatggtgggtttaatatagaaggaatttaaattggaagctaatttagaatcagtaaggagggacccaggctaagaaggcaatcctgggattctggaagaaaagatgtttttagtttttatagaaaacactactacattcttgatctacaactcaatgtggtttaatgaatttgaagttgccagtaaatgtacttcctggttgttaaagaatggtatcaaaggacagtgcttagatccgaggtgagtgtgagaggacaggggctggggtatggatacgcagaaggaaggccacagctgtacagaattgagaaagaatagagacctgcagttgaggccagcaggtcggctggactaactctccagccacagtaatgacccagacagagaaagccagactcataaagcttgctgagcaaaattaagggaacaaggttgagagccctagtaagcgaggctctaaaaagcacagctgagctgagatgggtgggcttctctgagtgcttctaaaatgcgctaaactgaggtgattactctgaggtaagcaaagctgggcttgagccaaaatgaagtagactgtaatgaactggaatgagctgggccgctaagctaaactaggctggcttaaccgagatgagccaaactggaatgaacttcattaatctaggttgaatagagctaaactctactgcctacactggactgttctgagctgagatgagctggggtgagctcagctatgctacgctgtgttggggtgagctgatctgaaatgagatactctggagtagctgagatggggtgagatggggtgagctgagctgggctgagctagactgagctgagctagggtgagctgagctgggtgagctgagctaagctggggtgagctgagctgagcttggctgagctagggtgagctgggctgagctggggtgagctgagctgagctggggtaagctgggatgagctggggtgagctgagctgagctggagtgagctgagctgggctgagctggggtgagctgggctgagctgggctgagctgggctgagctggggtgagctgagctggggtgagctgagctgagctggggtgagctgagctgagctggggtgagctggggtgagctgagctggggtgagctgagctgagctggggtgagctgagctggggtgagctgagctgagctggggtgagctgagctgagctgagctgagctgagctggggtgagctgagctgagctgagctggggtgagctggggtgagctgagctgagctggagtgagctgagctgggctgagctggggtgagctgggctgagctggggtgagctgagctgagctgagctgagctggggtgagctgagctgagctggggtgagctgagctggggtgagctgggctgagctgagctgagctgagctgagctgagctgagctgagctgagctgagctgagctgagctgagctgagctgagctgagctgagctggggtgagctgagctgagctgggctgagctggggtgagctgggctgagctgggctgagctgggctgagctggggtgagctgagctggggtgagctgagctgagctgggctgagctgagctgagctggggtgagctgagctgagctggggtgagctgagctgagctgagctggggtgagctgagctgagctgggctgagcagggctgagctggggtgagctgagctgagctggggtgagctgggctgagctgggctgagctgagctgagctgggctgagctgggctgagctgggctgagctgggctgagctgggctgagctggggtgagctgagctggggtgagctggggtgagctgagctggggtgagctgagctggggtgagctgagctgagctggggtgagctgagctggggtgagctgagctgagctggggtgagctgagctgagctggggtgagctgagctagggtgaactgggctgggtgagctggagtgagctgagctgaggtgaactggggtgagccgggatgttttgagttgagctggggtaagatgagctgaactggggtaaactgggatgagctgtggtgagcggagctggattgaactgagctgtgtgagctgagctggggtcagctgagcaagagtgagtagagctggctggccagaaccagaatcaattaggctaagtgagccagattgtgctgggatcagctgtactcagatgagctgggatgaggtaggctgggatgagctgggctagctgacatggattatgtgaggctgagctagcatgggctggcctagctgatgagctaagcttgaatgagcggggctgagctggactcagatgtgctagactgagctgtactggatgatctggtgtagggtgatctggactcaactgggctggctgatgggatgcgccaggttgaactaggctcagataagttaggctgagtagggcctggttgagatggttcgggatgagctgggaaaagatggactcggaccatgaactgggctgagctgggttgggagaccatgaattgagctgaactgagtgcagctgggataaactgggttgagctaagaatagactacctgaattgtgccaaactcggctgggatcaattggaaattatcaggatttagatgagccggactaaactatgctgagctggactggttggatgtgttgaactggcctgctgctgggctggcatagctgagttgaacttaaatgaggaaggctgagcaaggctagcctgcttgcatagagctgaactttagcctagcctgagctggaccagcctgagctgagtaggtctaaactgagttaaaaatcaacagggataatttaacagctaatttaacaagcctgaggtctgagattgaatgagcagagctgggatgaactgaatgagtttcaccaggcctggaccagttaggctaggacctcgttctatagaggcagactgtgtgctacagtggagtttcaagatgattccatgagtcctccccgcccccaacataacccaccttcctcctaccctacacgcctgtctggtgtgtaaatcccagctttgtgtgctgatacagaagcctgagcccctcccccacctccacctacctattactttgggatgagaatagttctcccagccagtgtctcagagggaagccaagcaggacaggcccaaggctacttgagaagccaggatctaggcctctccctgagaacgggtgttcatgcccctagagttggctgaagggccagatccacctactctagaggcatctctccctgtctgtgaaggcttccaaagtcacgttcctgtggctagaaggcagctccatagccctgctgcagtttcgtcctgtataccaggttcacctactaccatatctagccctgcctgccttaagagtagcaacaaggaaatagcagggtgtagagggatctcctgtctgacaggaggcaagaagacagattcttacccctccatttctcttttatccctctctggtcctcagagagtcagtccttcccaaatgtcttccccctcgtctcctgcgagagccccctgtctgataagaatctggtggccatgggctgcctggcccgggacttcctgcccagcaccatttccttcacctggaactaccagaacaacactgaagtcatccagggtatcagaaccttcccaacactgaggacagggggcaagtacctagccacctcgcaggtgttgctgtctcccaagagcatccttgaaggttcagatgaatacctggtatgcaaaatccactacggaggcaaaaacaaagatctgcatgtgcccattccaggtaagaaccaaaccctcccagcaggggtgcccaggcccaggcatggcccagagggagcagcggggtggggcttaggccaagctgagctcacaccttgacctttcattccagctgtcgcagagatgaaccccaatgtaaatgtgttcgtcccaccacgggatggcttctctggccctgcaccacgcaagtctaaactcatctgcgaggccacgaacttcactccaaaaccgatcacagtatcctggctaaaggatgggaagctcgtggaatctggcttcaccacagatccggtgaccatcgagaacaaaggatccacaccccaaacctacaaggtcataagcacacttaccatctctgaaatcgactggctgaacctgaatgtgtacacctgccgtgtggatcacaggggtctcaccttcttgaagaacgtgtcctccacatgtgctgccagtgagtggcctgggctaagcccaatgcctagccctcccagattagggaagtcctcctacaattatggccaatgccacccagacatggtcatttgctccttgaactttggctccccagagtggccaaggacaagaatgagcaataggcagtagaggggtgagaatcagctggaaggaccagcatcttcccttaagtaggtttgggggatggagactaagcttttttccaacttcacaactagatatgtcataacctgacacagtgttctcttgactgcaggtccctccacagacatcctaaccttcaccatccccccctcctttgccgacatcttcctcagcaagtccgctaacctgacctgtctggtctcaaacctggcaacctatgaaaccctgaatatctcctgggcttctcaaagtggtgaaccactggaaaccaaaattaaaatcatggaaagccctcccaatggcaccttcagtgctaagggtgtggctagtgtttgtgtggaagactggaataacaggaaggaatttgtgcgtactgtgactcacagggatctgccttcaccacagaagaaattcatctcaaaacccaatggtaggtatccccccttcccttcccctccaattgcaggacccttcctgtacctcatagggagggcaggtcctcttccaccctatcctcactactgtcttcatttacagaggtgcacaaacatccacctgctgtgtacctgctgccaccagctcgtgagcaactgaacctgagggagtcagccacagtcacctgcctggtgaagggcttctctcctgcagacatcagtgtgcagtggcttcagagagggcaactcttgccccaagagaagtatgtgaccagtgccccgatgccagagcctggggccccaggcttctactttacccacagcatcctgactgtgacagaggaggaatggaactccggagagacctatacctgtgttgtaggccacgaggccctgccacacctggtgaccgagaggaccgtggacaagtccactggtaaacccacactgtacaatgtctccctgatcatgtctgacacaggcggcacctgctattgaccatgctagcgctcaaccaggcaggccctgggtgtccagttgctctgtgtatgcaaactaaccatgtcagagtgagatgttgcattttataaaaattagaaataaaaaaaatccattcaaacgtcactggttttgattatacaatgctcatgcctgctgagacagttgtgttttgcttgctctgcacacaccctgcatacttgcctccaccctggcccttcctctaccttgccagtttcctccttgtgtgtgaactcagtcaggcttacaacagacagagtatgaacatgcgattcctccagctacttctagatatatggctgaaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgaaccccttgcggccgc

SEQ ID NO: 75 - DNA, 150288 bp, Artificial Sequence
  Description of Artificial Sequence: Synthetic polynucleotide
gcgcgccctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagactcgagtgccatttcattacctctttctccgcacccgacatagattctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacttcctctctctctctctctctctctatctctctccctccctccttccctccctcccgctctcttggttggacagctctccatcatccccctggacatgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacatatgttttgggtttttttgtgtctcagaccacagagtctgcccctcccaccaaagcccaggcagaaggatgaacccacgcccctggggcccaggcctcagcagcctctgcgggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtcccagcatgggctcctgactatgtcctcctgggacaaacccaaacccgctctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatattgcccaggagaggagtagctgacaaggcagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacgtctgccccaatactaacagctcctcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcccaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatatggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccacccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggccagggtctagtgcaggtgcccaggacaagaaagattgtgaatgcaggaatgactgggccacacccctcccgtgcacgccccctcttgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactctacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactgtctcctggcccctgctggaggccgcgccagagaggggagcagccgccccgaacctaggtcctgctcagctcacacgacccccagcacccagagcacaacggagtccccattgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgcccctgtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccccggtcctcactaggcctcagtcccggctgcgggaatgcagccaccacaggcacaccaggcagcccagacccagccagcctgcagtgcccaagcccacattctggagcagagcaggctgtgtctgggagagtctgggctccccaccgcccccccgcacaccccacccacccctgtccaggccctatgcaggagggtcagagccccccatggggtatggacttagggtctcactcacgtggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgttcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccccgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatacccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcacaacaggtgtttctcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaacagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacccgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaaccttctgccacagccctccctgtggggcaccgccgcgtgccatgttaggattttgactgaggacacagcaccatgggtatggtggctaccgcagcagtgcagcccgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggctggcccacattaccatttgctgccatccggccaacagtcccagaagcccctccctcaaggctgggccacatgtgtggaccctgagagccccccatgtctgagtaggggcaccaggaaggtggggctggccctgtgcactgtccctgcccctgtggtccctggcctgcctggccctgacacctgggcctctcctgggtcatttccaagacagaagacattcccaggacagctggagctgggagtccatcatcctgcctggccgtcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccaccagctgcaccagaccccgtcatgacagatgccccgattccaacagccaattcctggggccaggaatcgctgtagacaccagcctccttccaacacctcctgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaataccactcatggagcccccagccccaggtacagctgtagagagagtctctgaggcccctaagaagtagccatgcccagttctgccgggaccctcggccaggctgacaggagtggacgctggagctgggcccatactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccacggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtccttgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcaccccccaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccctctgctctcctctcatcaccccatgggaatccagaatccccaggaagccatcaggaagggctgagggaggaagtggggccactgcaccaccaggcaggaggctctgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcctatctctctcacccacggactcgcccacctcctcttcaccctggccacacgtcgtccacaccatcctaagtcccacctacaccagagccggcacagccagtgcagacagaggctggggtgcaggggggccgactgggcagcttcggggagggaggaatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagccgctcccacacaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgcgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccacggcaccctgccatgtcctgcatttctggaagaacaagggcaggctgaagggggtccaggaccaggagatgggtccgctctacccagagaaggagccaggcaggacacaagccccctccccattgaggctgacctgcccagagggtcctgggcccacccaacacaccggggcggaatgtgtgcaggcctcggtctctgtgggtgttccgctagctggggctcacagtgctcaccccacacctaaaacgagccacagcctccggagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacggtgtccccactggatgggaggacaagggccgggggctccggcgggtcggggcaggggcttgatggcttccttctgccgtggccccattgcccctggctggagttgacccttctgacaagtgtcctcagagagtcagggatcagtggcacctcccaacatcaaccccacgcagcccaggcacaaaccccacatccagggccaactccaggaacagagacaccccaataccctgggggaccccgaccctgatgactcccgtcccatctctgtccctcacttggggcctgctgcggggcgagcacttgggagcaaactcaggcttaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatgcacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgcgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggcacatgtgtggacactgagagccctcatatctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggcctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggtcatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagacagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggagacactgtgcatgtctggtacctaagcagccccccacgtccccagtcctgggggcccctggctcagctgtctgggccctccctgctccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggcaaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcgggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccttggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaacaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgtacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacgattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcccgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccacttcacctgcttctcctggggctctcaaggtcactgttgtctgtactctgccctctgtggggagggttccctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcgccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacccagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggatcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccggcctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgcccagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccccgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcagcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccataccatagggacagagaccagccgctaacatcccgagcccctcactggcggccccagaacaccccgtggaaagagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctgggactgaggggctgggggagcgtctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctcagcagggccttttgctgtttctgctttcctgtgcagagagttccataaactggtattcaagatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggagaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgaccggactcgcagggtttatgcacacttctcggctcggagctctccaggagcacaagagccaggcccgagggtttgtgcccagaccctcggcctctagggacacccgggccatcttagccgatgggctgatgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctcccttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggctctctccttatggttcccccacctggctcctgccgggacccttggggtgtggacagaaaggacgcctgcctaattggcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccgctgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcacccaccgacccgcccacctcctctccaccctggccacacgtcgtccacaccatcctgagtcccacctacaccagagccagcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagattctgtgcaggaccctctcacagtggaatacctccacagcggctcaggccagatacaaaagcccctcagtgagccctccactgcagtgcagggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagacctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcccttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaaaaagacaaagaaatttgtttttttgaataaagacaaatttcatcacacgaagataaagatgcaaagctccagacaggaaggcacggacagcacagtgaagcccggagcgggcgctggggggccaggggcatggcgggggtgccagcgtctctcggttcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgttgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagaaaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagccgagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttttgtttttagacggagttttgctccagcccaggctggagtgcaatggcacaatctcagctcactgcaacttccacctcccgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaagacatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactggcataaaaacagacacagagacaaacagaacaaaatttaaaaacccagaaataaatccacacacctacagcaaattcatttttgacaaagttgccaagaacatactctggggaatagataatgatatctcttcaataaatagtgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttgctacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataagaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccatcctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcctccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtaagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcaggggcacctcccctgcccccagacaccctgtgcccgtcagttcatccccagcagaggccctcaccaggcacacccccatgctcacacctggccccaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttttggggggaaataagggtgctgggtctcctgccaagagagccccggagcagcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcaggtaagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctctagactgagcattgcagactaatcttggatatttgtccctgagggagccggctgagagaagttgggaaataaactgtctagggatctcagagcctttaggacagattatctccacatctttgaaaaactaagaatctgtgtgatggtgttggtggagtccctggatgatgggatagggactttggaggctcatttgagggagatgctaaaacaatcctatggctggagggatagttggggctgtagttggagattttcagtttttagaataaaagtattagctgcggaatatacttcaggaccacctctgtgacagcatttatacagtatccgatgcatagggacaaagagtggagtggggcactttctttagatttgtgaggaatgttccacactagattgtttaaaacttcatttgttggaaggagagctgtcttagtgattgagtcaagggagaaaggcatctagcctcggtctcaaaagggtagttgctgtctagagaggtctggtggagcctgcaaaagtccagctttcaaaggaacacagaagtatgtgtatggaatattagaagatgttgcttttactcttaagttggttcctaggaaaaatagttaaatactgtgactttaaaatgtgagagggttttcaagtactcatttttttaaatgtccaaaattcttgtcaatcagtttgaggtcttgtttgtgtagaactgatattacttaaagtttaaccgaggaatgggagtgaggctctctcataacctattcagaactgacttttaacaataataaattaagtttcaaatatttttaaatgaattgagcaatgttgagttggagtcaagatggccgatcagaaccagaacacctgcagcagctggcaggaagcaggtcatgtggcaaggctatttggggaagggaaaataaaaccactaggtaaacttgtagctgtggtttgaagaagtggttttgaaacactctgtccagccccaccaaaccgaaagtccaggctgagcaaaacaccacctgggtaatttgcatttctaaaataagttgaggattcagccgaaactggagaggtcctcttttaacttattgagttcaaccttttaattttagcttgagtagttctagtttccccaaacttaagtttatcgacttctaaaatgtatttagaattcattttcaaaattaggttatgtaagaaattgaaggactttagtgtctttaatttctaatatatttagaaaacttcttaaaattactctattattcttccctctgattattggtctccattcaattcttttccaatacccgaagcatttacagtgactttgttcatgatcttttttagttgtttgttttgccttactattaagactttgacattctggtcaaaacggcttcacaaatctttttcaagaccactttctgagtattcattttaggagaaagactttttttttaaatgaatgcaattatctagacttatttcagttgaacatgctggttggtggttgagaggacactcagtcagtcagtgacgtgaagggcttctaagccagtccacatgctctgtgtgaactccctctggccctgcttattgttgaatgggccaaaggtctgagaccaggctgctgctgggtaggcctggactttgggtctcccacccagacctgggaatgtatggttgtggcttctgccacccatccacctggctgctcatggaccagccagcctcggtggctttgaaggaacaattccacacaaagactctggacctctccgaaaccaggcaccgcaaatggtaagccagaggcagccacagctgtggctgctgctcttaaagcttgtaaactgtttctgcttaagagggactgagtcttcagtcattgctttagggggagaaagagacatttgtgtgtcttttgagtaccgttgtctgggtcactcacatttaactttccttgaaaaactagtaaaagaaaaatgttgcctgttaaccaataatcatagagctcatggtactttgaggaaatcttagaaagcgtgtatacaattgtctggaattatttcagttaagtgtattagttgaggtactgatgctgtctctacttcagttatacatgtgggtttgaattttgaatctattctggctcttcttaagcagaaaatttagataaaatggatacctcagtggtttttaatggtgggtttaatatagaaggaatttaaattggaagctaatttagaatcagtaaggagggacccaggctaagaaggcaatcctgggattctggaagaaaagatgtttttagtttttatagaaaacactactacattcttgatctacaactcaatgtggtttaatgaatttgaagttgccagtaaatgtacttcctggttgttaaagaatggtatcaaaggacagtgcttagatccgaggtgagtgtgagaggacaggggctggggtatggatacgcagaaggaaggccacagctgtacagaattgagaaagaatagagacctgcagttgaggccagcaggtcggctggactaactctccagccacagtaatgacccagacagagaaagccagactcataaagcttgctgagcaaaattaagggaacaaggttgagagccctagtaagcgaggctctaaaaagcacagctgagctgagatgggtgggcttctctgagtgcttctaaaatgcgctaaactgaggtgattactctgaggtaagcaaagctgggcttgagccaaaatgaagtagactgtaatgaactggaatgagctgggccgctaagctaaactaggctggcttaaccgagatgagccaaactggaatgaacttcattaatctaggttgaatagagctaaactctactgcctacactggactgttctgagctgagatgagctggggtgagctcagctatgctacgctgtgttggggtgagctgatctgaaatgagatactctggagtagctgagatggggtgagatggggtgagctgagctgggctgagctagactgagctgagctagggtgagctgagctgggtgagctgagctaagctggggtgagctgagctgagcttggctgagctagggtgagctgggctgagctggggtgagctgagctgagctggggtaagctgggatgagctggggtgagctgagctgagctggagtgagctgagctgggctgagctggggtgagctgggctgagctgggctgagctgggctgagctggggtgagctgagctggggtgagctgagctgagctggggtgagctgagctgagctggggtgagctggggtgagctgagctggggtgagctgagctgagctggggtgagctgagctggggtgagctgagctgagctggggtgagctgagctgagctgagctgagctgagctggggtgagctgagctgagctgagctggggtgagctggggtgagctgagctgagctggagtgagctgagctgggctgagctggggtgagctgggctgagctggggtgagctgagctgagctgagctgagctggggtgagctgagctgagctggggtgagctgagctggggtgagctgggctgagctgagctgagctgagctgagctgagctgagctgagctgagctgagctgagctgagctgagctgagctgagctgagctgagctggggtgagctgagctgagctgggctgagctggggtgagctgggctgagctgggctgagctgggctgagctggggtgagctgagctggggtgagctgagctgagctgggctgagctgagctgagctggggtgagctgagctgagctggggtgagctgagctgagctgagctggggtgagctgagctgagctgggctgagcagggctgagctggggtgagctgagctgagctggggtgagctgggctgagctgggctgagctgagctgagctgggctgagctgggctgagctgggctgagctgggctgagctgggctgagctggggtgagctgagctggggtgagctggggtgagctgagctggggtgagctgagctggggtgagctgagctgagctggggtgagctgagctggggtgagctgagctgagctggggtgagctgagctgagctggggtgagctgagctagggtgaactgggctgggtgagctggagtgagctgagctgaggtgaactggggtgagccgggatgttttgagttgagctggggtaagatgagctgaactggggtaaactgggatgagctgtggtgagcggagctggattgaactgagctgtgtgagctgagctggggtcagctgagcaagagtgagtagagctggctggccagaaccagaatcaattaggctaagtgagccagattgtgctgggatcagctgtactcagatgagctgggatgaggtaggctgggatgagctgggctagctgacatggattatgtgaggctgagctagcatgggctggcctagctgatgagctaagcttgaatgagcggggctgagctggactcagatgtgctagactgagctgtactggatgatctggtgtagggtgatctggactcaactgggctggctgatgggatgcgccaggttgaactaggctcagataagttaggctgagtagggcctggttgagatggttcgggatgagctgggaaaagatggactcggaccatgaactgggctgagctgggttgggagaccatgaattgagctgaactgagtgcagctgggataaactgggttgagctaagaatagactacctgaattgtgccaaactcggctgggatcaattggaaattatcaggatttagatgagccggactaaactatgctgagctggactggttggatgtgttgaactggcctgctgctgggctggcatagctgagttgaacttaaatgaggaaggctgagcaaggctagcctgcttgcatagagctgaactttagcctagcctgagctggaccagcctgagctgagtaggtctaaactgagttaaaaatcaacagggataatttaacagctaatttaacaagcctgaggtctgagattgaatgagcagagctgggatgaactgaatgagtttcaccaggcctggaccagttaggctaggacctcgttctatagaggcagactgtgtgctacagtggagtttcaagatgattccatgagtcctccccgcccccaacataacccaccttcctcctaccctacacgcctgtctggtgtgtaaatcccagctttgtgtgctgatacagaagcctgagcccctcccccacctccacctacctattactttgggatgagaatagttctcccagccagtgtctcagagggaagccaagcaggacaggcccaaggctacttgagaagccaggatctaggcctctccctgagaacgggtgttcatgcccctagagttggctgaagggccagatccacctactctagaggcatctctccctgtctgtgaaggcttccaaagtcacgttcctgtggctagaaggcagctccatagccctgctgcagtttcgtcctgtataccaggttcacctactaccatatctagccctgcctgccttaagagtagcaacaaggaaatagcagggtgtagagggatctcctgtctgacaggaggcaagaagacagattcttacccctccatttctcttttatccctctctggtcctcagagagtcagtccttcccaaatgtcttccccctcgtctcctgcgagagccccctgtctgataagaatctggtggccatgggctgcctggcccgggacttcctgcccagcaccatttccttcacctggaactaccagaacaacactgaagtcatccagggtatcagaaccttcccaacactgaggacagggggcaagtacctagccacctcgcaggtgttgctgtctcccaagagcatccttgaaggttcagatgaatacctggtatgcaaaatccactacggaggcaaaaacaaagatctgcatgtgcccattccaggtaagaaccaaaccctcccagcaggggtgcccaggcccaggcatggcccagagggagcagcggggtggggcttaggccaagctgagctcacaccttgacctttcattccagctgtcgcagagatgaaccccaatgtaaatgtgttcgtcccaccacgggatggcttctctggccctgcaccacgcaagtctaaactcatctgcgaggccacgaacttcactccaaaaccgatcacagtatcctggctaaaggatgggaagctcgtggaatctggcttcaccacagatccggtgaccatcgagaacaaaggatccacaccccaaacctacaaggtcataagcacacttaccatctctgaaatcgactggctgaacctgaatgtgtacacctgccgtgtggatcacaggggtctcaccttcttgaagaacgtgtcctccacatgtgctgccagtgagtggcctgggctaagcccaatgcctagccctcccagattagggaagtcctcctacaattatggccaatgccacccagacatggtcatttgctccttgaactttggctccccagagtggccaaggacaagaatgagcaataggcagtagaggggtgagaatcagctggaaggaccagcatcttcccttaagtaggtttgggggatggagactaagcttttttccaacttcacaactagatatgtcataacctgacacagtgttctcttgactgcaggtccctccacagacatcctaaccttcaccatccccccctcctttgccgacatcttcctcagcaagtccgctaacctgacctgtctggtctcaaacctggcaacctatgaaaccctgaatatctcctgggcttctcaaagtggtgaaccactggaaaccaaaattaaaatcatggaaagccctcccaatggcaccttcagtgctaagggtgtggctagtgtttgtgtggaagactggaataacaggaaggaatttgtgcgtactgtgactcacagggatctgccttcaccacagaagaaattcatctcaaaacccaatggtaggtatccccccttcccttcccctccaattgcaggacccttcctgtacctcatagggagggcaggtcctcttccaccctatcctcactactgtcttcatttacagaggtgcacaaacatccacctgctgtgtacctgctgccaccagctcgtgagcaactgaacctgagggagtcagccacagtcacctgcctggtgaagggcttctctcctgcagacatcagtgtgcagtggcttcagagagggcaactcttgccccaagagaagtatgtgaccagtgccccgatgccagagcctggggccccaggcttctactttacccacagcatcctgactgtgacagaggaggaatggaactccggagagacctatacctgtgttgtaggccacgaggccctgccacacctggtgaccgagaggaccgtggacaagtccactggtaaacccacactgtacaatgtctccctgatcatgtctgacacaggcggcacctgctattgaccatgctagcgctcaaccaggcaggccctgggtgtccagttgctctgtgtatgcaaactaaccatgtcagagtgagatgttgcattttataaaaattagaaataaaaaaaatccattcaaacgtcactggttttgattatacaatgctcatgcctgctgagacagttgtgttttgcttgctctgcacacaccctgcatacttgcctccaccctggcccttcctctaccttgccagtttcctccttgtgtgtgaactcagtcaggcttacaacagacagagtatgaacatgcgattcctccagctacttctagatatatggctgaaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgaaccccttgc

SEQ ID NO: 76 - DNA, 185159 bp, Artificial Sequence
  Description of Artificial Sequence: Synthetic polynucleotide
cggccgcgcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattcgagctcggtacccggggatcctctagagtcgacctgcaggcatgcaagctttcctctagactatgttgctaagtcttaagcttatctctctgttgctcagactcatctaggaatttcagaaatttctgttctagcatctcttccagcttttgtctccaaccctcattctcttctttctttttttttttaaattatatgttctctgtctttttaaaaaactttttaaaattaggtatttatgtcatttacatttccaatgctatcccaaaagtcccacccacgctccccaacccactatcccacccacccactcccacttcttggccctggcattcacagtgtactgagacatataaagtttgcacaaccaatgggcctctctttccactgatggccgactaggccatcttctgatacatatgcagctagagacacgagattctgggggtactggttagttcatattgttgttccacctatagggttgcagatccttttagctccttgggtactttctctagctcctccattgggggccctgtgatccatccaatagctgactgtgagcatccacttctgtgtttgctaggccccagatagtctcacaagagacagctatatctgggtcctttcagcaaaatcttgctagtgtatgcaacggtgtcagagtttggaagctgattatgggatggatccccggatatggcattctctagttggttcatccttttgtctcagctccaaactttgtctctgtaactccttccatgggtgttttgttcccagttctaaggaggggcaaagtatccacactttggtcttcattcttcttgagtttcatgtgttttgcaaattgtatcttatatcttgggtattctaagtttctgggctaatatccacttatcagtgagtacacattgtgtgagttcttttgtgattgggttacctcactcagtatgatgccctccaggtccatccatttgcctaggaatttcataaattcattctttttaatagctcagtagtactccattgtgtagatgtaccacattttctgtattcattcctctgttgaggggcatctgggttctttccagcttctggctattataaataaggctgctatgaacatagtggagcatgtgaccttcttaccggttgggacatcttctggatatatgcccaggagaggtattgctggatcttccggtagtactatgtccaattttctgaggaactgacaaactgatttccagagtggttagtaccagcttgcaatcccaccaacaatgagaggagtgttcgtctttctccacatcctcaccagcatgctgctgtcacctgaatttttgatgcttagccattctgactggtgtgaggtggaatctcagggttgttttgatttgtatttccctgatgattaaggatgctgaacattttctcaggtgcttctcagccattcagtattctttaggtgagaattctttgtttagctctaagccccatttttttaatggggttatttgattttctggagtccaccttcttgagtttttttttccattttttattacataatttcctcaattacatttccaatgctatcccaaaagtcccccataccctcccccccccaattccctacccaccccttcccatttttttggccctggcgttcccctgtactggggcatataaagtttgtgtgtccaatgggcttctctttccagtgatggctgactaggccatcttttgatacatatgcagctagagtcaagagctcccgggtactggttagttcataatgttgttccacctatagggttgcagatccctttagcttcttgggtactttctctagctcctccattgggagccctgtgatccatccaatagctgactgtgagcatccacttctgtgtttgctaggccccggcatagtctcacaagagacagctacatctgggtccttttgataaaatcttgctagtgtatgcaagggtgtcagcatttggaagctgattatggggtggatccctggatatggcagtctctacatggtccatccttttgtctcagctccaaactttgtctctgtaacttcttccatgagtgttttgttcccaattctaaggaggggcatagtgtccacacttcattcttcattcttcttgagtttcatgtgtttagcaaattgtatcttatatcttgggtatcctaggttttgggctaatatccacttatcagtgagtacatattgtgtgagttcctttgtaaatgtgttacctcactcaggatgacgccctccaggtccatccatttggctaggaatttcataaattcattctttttaatagctgagtagtactccattgtgtaaatgtaccacattttctgtactcattcctctgttgaggggcatctgggttctttataggttctggctattataaataaggttgctatgaacatagtggagcatgtgtccttcttaccggttgagacatcttctggatatatgcccaggcgaggtattgctggatcctccggtagtactatgtccaattttctgaggaactgccagactgatttccagagtggttgtacaagcctgcactctcaccaacaatggaggagtgttcctctttctccacatccacgccagcatctgctgtcacctgaatttttgatcttagccattctgactggtgtgaggtggaatctcagggttgttttgatttgcatttccctgatgattaaggatgttgaacatttttttcaggtgcttctctgccattcggtattcctcaggtgagaattctttgttcagttctgagccccattttttaatggggttatttgattttctgaagtccaccttcttgagttctttatatatgttggatattagtcccctatctgatttacgataggtaaagatcctttcccaatctgttggtggtctttttctcttattgacggtgtcttttgccttgcagaaactttggagtgagttctttatatatattggatattagtcccctatctgatttaggataggtaaagatcctttcccaatctgttggtgacctttttgtcttattgacggtgtcttttgccttgcagaatctttgcaattttatgaggtcgcatttgtcaattctcgatcttacagcacaagtcattgctgttctgttcaggaatttttcctctgtgcccatatcttcgaggcttttacctgctttctcctctatatgtttgagtgtctctggtttaatgtggagttccttaatccacttagatttgaccttagtacaaggagataggaatggatcaattcgcattcttctacatgataaccgctagttgtgccagcaccatttgttgataatgctgtcttttttccactggatggtttttgctcccttgtctaagatcaagtgaccataggtgtgtgggttcatttctgggtcttcaattctatttcattggtctacttgtctgttgttataccagtaccatgcagattttatcacaattgctctgtagtagagttttaggtcaggcatggtgattacaccagaggttttttttatccttgagcagagtttttgctatcctaggttttgtgttatttcagatgaatttgcagattgccctttccagttcgttgaagaattgagttggaattttgatggggattgcattgaatctgtagattgctttggcaatatagccatttttactatattgatcctgccaatccatgagcatgggagatctttccatcttctcaaatcttctttaatttctttcttcagagacttgaagttcttgtcatacagatctttcacttccttagttagagtcacgctaaggtattttatattatttgtgactattgagaagggtgttgtttccctaatttctttctcagcctgtttatcctttgtgtacagaaaagccattgacttgtgttagttaatctcatatccagctacttcactgaagcggtttatcaggtttaggagttctctggtgtaatttttagggtcactcatatatactatcatatcatctgcaaaaagtgacattttgacttcttcctttccaatttgtatccccttgatctccttttgttgtcgaattgctctggcaaggacatcaagtactatattgaataggtagggagaaaatcggcacccttgtctagtccctgattttagtaggattgcttcaagtttctcaccatttactttgatgttggctactggtttgctgttgaatgctttttatcatgtttaggtatgggccttgaattcctgatctttccaagacttttatcatgaaagggtgttggattttgtcaaatgctttctccagcctttcattctgaggttgtgtctgtctttttccctgagatgggtttcctgtaagcagcaaaatgttgggtcctgtttgtgtagcccgtctgttattctatgtctttttattggggagttgagtccattgatattaagatatattaaggaaaagtaattgttgcttcctattatttttgtttttaaagttggcattctgttcttgtggctgtcttcttttaggtttgttgaaggattcctttcttgctttttctaggtcgtggtttccatccttgtattcattttttttctgttattatcctttgaaggactggattcatggatagataatgtgtgaatttggttttgtcttggaatacttttgtttctccatctacggtaattgagagtttggctgggtatagtagcctgggctggcaattgtgttgtcttagtgtctatataatgtctgtccaggatcttctggctttcatagtctgtggtgaaaaatctggtgtaattctgataggcttgcctttatatgttacttgaatttttcacttactgcttttaatattctttctttatttagtgcatttgttgttctgattattatgtgtcgggaggaatttcttttctggtccagtctatttggagttctgtaggcttcttgtatgttcacgggcatctctttctttaggtttgggaagttttcttctataattttgttgaagatatttgctggcccttcaagttgaaaatgttcattctcatctactcctattattcgtatggttggtcttctcattgtgtcctggatttcctggatgttttgagttaggatctttttgcattttccattttctttgattgttgtgcagatgttctctatggaatcttctgcacctgatattctctcttccatctcttgtagtctgttgctgatgctcgcatctatggttccagatttctttcctagggtttctatctccagtgttgccccactttgggttttctgtatagtgtctacttccctttttagatctagtatggttttgttcatttccatcacctgtttgggtgtgttttcctgtttttctttaaagacttgcaactctttagcagagttctcctgtatttaagtgagttattaaagtccttcttgatgtccagtaccataattgtgagatatgcctttaaatccaagtctaggtttttgggtgtgttggggtgccctggactggctgagttgggagtgctgcattctgatgatggtgagtggtcttggtttctgctagtaagattcttacatctgcctttcgccatctggtaatctctggagtcagttgttaaagttgtctctggttaaagcttgttcctctcgtgattctgttattctcttccagcagacctgggagactagctctttcctgagtttcagtggtcagagcactctctgcaggcaggatttcctctttcagggaaggtgcacagatatctggtgttcagatttgcctcctggcagaagatgatggcctgaaacaggacctgtcccagaagctgttagcttctgtagtcaacactgtcacctgtgcagactagtctcggtggagtccgggaaccaagatgtctcctgcagatgctctggcattcccttctgggccgggtgatcacctctcctctggcagggaaggtgccctggtgtctggaacccgaaaagggggctgcctcagaagctctgtggctactgcctgtcccagaagctgttagcttctgtagtccacactctcacctgtgcagactagtcttggtggagtctgggaaccaagatgtctcccgcagatgctccagccattctcctctttctgttgcttattttgacctatgaaatcctggacatatagttctagtgttgcttgtaatctcttttctaagccaaggaattttttttatctagggcacaatcttttgagaagacatattaaatcaagagaataaatattgcaagaccaataaatgataaggtatctattttctttaaatccatcgctgtcaaaccattcaaaatatcctcacataaagccaaaaagatatttattgtgtttcccatcttagttgagttcaagtcaatattttggtgccattttgttgcagtaaatctctaacacaaatatgcctgggcaatgaaaacacaactcagttaatatgaatacagattgttcagatctaccactacactaccatcttcttcatctaagagaccccttagaacttgcagtttctccaggccttgtgcttctgcgctgcttttcttcttcttcctcttctacattgcttctctcataaacctacttctttttttccctccttctgttccatcttcccttttatctgcccaatcattagctctcctttattttacaaattaaggtgtgaagccggtttctaggaaatcacctgagtgctgacttgttccttgttcagagccacgcacaggagaacagaattaacatcaaatataattatccccagggctatccacaacacgtgcatcctataagatcaccacggactaatgctggtcttcaattacaacataaacaacaaaaaccccacatatatgtggaaacaaatcgaactatacaaagaatcaatgaaaccaggagcttgttctttgagaaaaatcaacaagatagataaacccttagccagactaaccagagggcacagagacagtatccaaattaataaagtcagaaatgaaaggaagacataacaatgaaatatatcttaaaataattaatctgtttgtagactattagcagttgaaaatattaaaatcatgttctacaaacgtggaattattattgataattttctcactgtgcttgaaattagcattttcttaatgtttaacttcaaagagtttttgctattttgaaatattaaacatatacttactgataaaataatttccctcctaacaacactgataatctttttttaagtaaactgattattagacaatgtacacagatatataatgtgttttaaatactctcccactgtcaggtggtatcatatagggcctttgaatatatttttaaatgtattatttgtaatattttatggtctctcctatgcttatttctgaaagaatattttgtatgttttgaaacaatttagtatttaacattagatataggatcctcagttatggatagtattaaatattcattaatgatatttttaaggtataaaaggatatgaatataaaagtttaacaaattttatgtattatttgattctaaaaatactcaatattattaatatgtttgatgtttaaaatgcatttaaataataaaaacatttaaaaaaataaaatcaagaaatgaggttctaagcagaggtcaaggaaaatgaggaatagaaaaatagtaaaaatcaatatgtccatttattcaaggaaagctcctacatagacattgcaccagattagcaaatattatggtcctcatattagtttaagttaggagactatgcttatgttatctatttacattctaaggagcctagacatttgtgaatggattacattataagaggaggatgtctacttaagtaggcatgaacgcctgtgcattgcaccctatgagttccatcagcattccatgattggagtatgaagaacagcattatagacattacccagaaccttagtggttctagaatgccaagataaaacaatctaaccttctggatagtagggataaatgttcctatatcatcagaattcactggtgccctgaggatgttaccctgctaactgacaattcacaggacatcacatggattctgataagttgcagaaaagaggagatgcattcaattggtcctcctccttctaagctgcaatattaggtgcatccaatttgtgaacttcaatttagattacaatagacatgaataatctgaattcatgtagtacatatttttgttttaatatgagttaccattgttcagaaaattaaatacacatgatcacatattcctacatagtgctgttagtttttcacatctctgggacaatattccaaatatctccttcattagtgaaaatatcaactactgtaaagcttagctaacatgcctttgcaggaataagaacatcctggattgaaagctacacagggagatgtaaaactttctaagcacacacattctccatccattaggatcatggtccatgagatttttctctctctcttcttcccattaaatgcatgtacatgcaggttgggaaacagattgtgttgcagaatacatttgcttgatttccacttccttctcaatgcaaatatttttgaagtgttaattttgctgtgagtaccacagtggttcttgctctttctgttgactcctgtctgtgaatgttccaggaattcacacatggacacacgtggggctgcatctgagctccagactcactgttgtccttctgtcctcagctgctctggcccaggcacagcctcgtgaattcaacaaagaccctgatctctcttgtttacacctcattacaaatgggaactgttagaggtggacccaactgcatttccatgaggaaagcacatgagtttgagagggtcgttgatgataaggtagaaacaactttaattcataggctgagatatcagtcatcacctccagataaacaagagccatttcttcctgcatctgagccctgtaagcacactagctttaggaatatgttactgctgaagtcagattgggcaacttcatagtatacaatagaaaatctacctgcagatgagttcagaaccagcagggggcacaatggggccaagaatccctagcagagagatgtggtgtgtgtgcaggggactctgcatcctctgtggtttcctttcttaacttacatgtacctgtagtgattgacatgtaacgtttccacgctcaaacactgtgaagatactttgctaaacacttcaaagatttatgttttcttgatgtgtgcatgtgtgtattcttttttgtttttagacacagggtttctctgtgtagtcctggctgccctggaactcactctgtagaccaggctggcctcgaactcagaaatctgcctgcttctgcctcccaagtgctgaagttaaagacatgtgccaccattgcctggccatgtgtgtattcttgatgcactcttctgttgacagatacacagtttatttccataatttatttattgtgatggtgctgcaataatcacttatgtacaaatgtttctgaagtatatttagttttggtcatttgggtgattatttttttctttctagtatatagcattttggaaaggtagatattaattgtatgtatgggaaggaggctgtaaattctaataacttagctgcttttgaaatttgtcctcaattctatcatccttgtaaccaccttaaatccatctattagccttgtcacaagtgagccactgtctcaggctgcaaatctttttatagattaggtcgtgatgttacatccacagcctctgcacaatgctcaggggtgggatatgggatgaattccctcagacagcattaggacttggatctcagcagactgattcttgacccaaatgtctcttcttctctagcaggagtaagtccttatctaagatgtactctgctcatgaatatgcaaatcaattgagtctatggtggtaaatatagggatgtctacacccctcaaaaacttaagatcactgtcgtcttcacagtcacaggagtacacaggacatcaccatgtgttggagctgtatcatcctcttcctgttagcaacagctgcacgtaaggggcttacagtagcaggcttgaggtctggccatacactcatgtgacaatgacatccactctgtccttcccttcacaggtgtgcactcccaggtccagctgcagcagtctggggctgagctggtgaggcctggggcctcagtgaagatttcctgcaaggcttttggctacaccttcacaaaccatcatataaactgggtgaagcagaggcctggacagggcctggactggattggatatattaatccttataatgattatactagctacagaaccagaagttcaagggcaaggccacattgactgtagacaaatcctccagcacagcctatatggagcttagcagcctgacatctgaggactctgcagtctattactgtgcaagacacagtgctacaaacacatcctgagtgtgtcagaaaccctggaggagaagcaagcagagctggaatggagatgacagaaagattatcatttagacttgctcagaaagagaaattttgaatgcccatttattgcctcttccttacagtactatagtgcctgtttttgttgacattttcaaactaatttccaaagtcactaccacaatttacaatcacataaaaagcaagcaaggataacattattttctgtgcttacttgccatttatattcttgcttattctcatctcactgaggtcatattgggacattaaatttctggggttactttttattaaaaatttttcattattcattcactttacatccttctagtcttcctctcacacatgccctatccctttctcctctgagaggatggagccctccctaccctcgtatccccttacccaggcacatcaagtgtctgcagtactaggaatattctctgtcaatgctgccagacaaggcagacaagttaggggatcaggattcacaggaaggcaacagcttgagggacagcccccactgaagttattggtggattcacatgaagactgagttgcacatctgctacatatattcaggggtcctatttacagctcaagtagactcttgttggtggtttagtctcttagaaccccaagtgtccaggttagttgactctgtgggtcttcctttggagttcctatcccctccagatccctcagttcttctcccaactcttccataagacacccgtaggtccatccaatgtttggttttgggtttttctgcatctgcttcagtcagctgctgggtggagcatctctgaggataattatgagaagctcttatgtgcaagcataacaggatatcattattagtgtcagggactggtgcttggccatgggatgggtctcaagtttggtcagttatttggccattcccacagtctctgataatctttgtccctgcatttcttgtagacaggaaaaatattgggttgaaagttttgtgggtgggttggcgtctctattgctccactgggcttctttctggatataggagtttgcctcttcaggttccatattcccaaagtagtgtgtcacactaaggtcactcccatacagagggacactcattctcttgccacgtctctgtccaccttcattggacctgaggttcctgaatcatacagaactgcatgtgtgcaaccacacagaacaaggctatctatcagaggcctaccataccaggaccatcaaggttcaccttactcccaatactgactacaaaaagaacatcaaggaccaatgcagtctatatggataaacacacttgaaagaacacaaacaagattgagggcaacatgacacctccaaagcatacctaaccgagtacagcatgccctggatatcctaacacaatcaaaacacaagaaagttaccttaaatccagtcttataaaggtgatgaaggcctttaaataggaaatgaattaatccttaggataatacaggacaatacattcgaacagatagaggtctttaggaggaaagaaataaatccctcaaagacatacatgaaaatacaattaaacaggtgaaagtaataactacaatggtgtaagacctaaaaatggaaatagaagcaataaagtaacacaaacttagaatcttgaaggtggaaaacctagagaacaggaatactagatgcaaggatgatatcttctaggtccatccatttgcttgcacaatttatcatgtccttgcttttaatagttgaacagtatttcattgtttaaatgaaccacatgttctgtctccattctctggatgagggggtgagcaagtttttccacattctggctattacaaatagagctgctatgaacctagtagaaaacatatcctgtgtatggtggagagttttggagtatatcaccaagagtgttatagctgggtcttcatgtagaactattcctaattttctgagaaatcccaagtcagatttctagaatggttgttcaagtgttcactccaaccatcaatggaggactgttttccttgccagcatgtgctgtattttgagtttttgatcctagccagttttatcctgcatttcacacttagatatggactatggtacaggacagagagaaaccaaccttctactcaccaggatattctacctgctaccaatttatttatttatttatttatttatttatttatttatttatttatttatattagagaacaacaccatgcagtttagaagaagtactaagacgtcagtgatgttatactgtgcctaaccttgcattgtacaatctcagctttcaggtaagacagtgcatgactcttatgcagtgccaactgttttctgattgtatttatggtctattgcctaggaatgacctcctctcaaataaacatggtcaaaagcccatggcctgagatgacagagcccctagtagaccctagttgtatttctgaagtttagatatcataatgacttataaatacttatgtttatacaatagattagagctgctctcagccatgaccaaggagcttctgtgttcaatgaataatgattgatgcagacattcgtgagtggtcaaagtggtgagaatgattagagagtcctcagccacacaagcgttaatgatatgaactttccaatatattaactgtattaatgaataaatgcagacatcatatgagatctcattagtagttcttaggtattgcatttttatatacaattatgcatatcagtacattatagtgtataaaggaaattgtctagcataatagagaaaaataggacagtcaagaaacaaaagagtagaaattatgggtgaaatatgcagtgtgaaatatttacatgaaaattttaaccatatgtaaaattgttatttttgtttttcagaatgagtttgctcattctttgacatttttattcctgtgtgaaatatatcaggatcatatgtatcccattctgatggtctgacttccactgggaatttccaatatatctcttccaactaactgaccagtttctttttttcttattttctctctttctcgttttgttttgctttgttttgtttttcaagacagggtttctctgtgtagctctggctgtcctggaactcactttgtagatcaggctggcttcgagctcataaatccacttgcctctgcctcctgagtgctgggattaaaggagtggctaccacgcccggctagtttttttttttcttataagaacaacatttactggatggtcacttacatattcagaggttcagtcaattattatcaaggcagaagcatggcagtggtccagtagtcatggcactggggaaggagctgagagatctacatcttgctccaaagggaaagaggaatagtctgacttccatgtgtttcagaggagggtttcatttcccacccccacagtgacacacttcctccaacacggccacacctcctaatattgccactcttggatcaagcatattcacaccacaaaggaaagtttagagataaacattaagaaaattaatgaagtcattttatcttatatgctcaacatgactagtacttaaaaccataattttacatgtacaatatttcatggcataacatattttttatatttttattagatattttctttatttatatttcaaatgtgataccctttcccaattcccctccaaaaatcccctatgccttcccctcatagccagctcccaaacccacccactcctgctttctggtcctggcattcccctatactggggcataaaaccttcacaggaccaagtgcctcttctccattgatggccaattaggccatcctctgctacatatgcagctagagccatgagttccaccatgtgttttctttgattggtggtttagttccagggagctctgggggtattggttagttcatattgttcctcctatggggctgcaaaccctttcagccccttgggtattttttctagctccttcattggggaccctgtgctccatccaatggatgagtgagcctccacttttgtatttgtcaggaactggcagagtctctcaggagacaattatatcaggctcctgtcagcaaaatctcgttggcatctgcaatagtgtctgggtttggtggttgtttatgggatggatttctgggtggggcagtctctggattgtcattcctttagtctctgcttccacctttgtctttgtaactccatccatgggtattttgttcccccttcaaagaaggatcaaaatatccacactttagtcttccttcttcttgagtctcatgtgtttttcaaattgtatcttgggtattctgagcttctaggctaatatccacttatcagtgagtgattatcatgtctgttcttttgtgattgagttacctcacttagcatgatatcctccaggtctatccatttgtctaagaatttcataaagtcattgtctttaatagctgcatcgtactcaattgtgtaaatgcaccacattttctttatccattcctctgttgagggacacttggtttttcccagcttctggttattataaataaggctgctatgaacatagtggaacatgtgtccttagtacatgttggaacatcttctgggtatatgcccaggagtggtattgctggatcttctggtggtactatgtccaaatttttggggaaccatcaaactgatttcctgagtggttgtacaagcttgcaatcccacaccagcaatagtggaatgttcatctttgtccaagtccttgccagcatctgctgtcacctgagtttttgatcttagccattcttactggtgtgaggtggaatcttggggttgttttgatttgcatttccctgatgtttaagggttttgaacatttttaggtgcttattagacatttggtattcctcagtttagaaatctttgtttagctctgtaccacatttttgaatagggttatttggttttctggagtctaacttcttgagttctttgtacatattggatattagccctctatcagatttagaattagtaaggatctttccccaaactgttggtggttcttttgtcttattgacagtgtactttgccttagagaagctttgcaattttatgaggtcccatttgtcaattcttgatcttatagtacaagccattggtcttttgttcaggaatttttcccatgtgtccatatgttcaaggcatttccccactttctccactacaagttttagtgtctctggttttatgtggaggtccttgatccacttagatttgagctttgtacaaggagataagaatggatagattcacattcttctacatgctctctgccagttgagctagcaccatttgttgaaaatgctgtcttttttttcccccactggatggtttttagctcttttggccaagatcaagtgaccattggtgtgtgggttcatttcttggtcttcaattctagttcactgacttacctgtttgtcactgtacaaggaccatgcagcttttttcacaattgctctgtagtacagcttgaggtctgggatggtgattctaccagagagattcttttactgttgtgaataatttttgctatcataggatatttttttatttcagatgaatttacaaattgctctttctaactctgtgaacaattgagttggaattttgattgtgattgctttgaatactcaagatataatttacaaaacacatgaaacttaacaaggactactaaagtgcagatacttcgatccttcttagaagggggaacaaaatacccatagatggagttacagagacaaagttcggagcagagactataggaacgaccatccagaggtccacctggggatccatcatgtaaacaaccacccaaaacagacactattgtggatgccaagaagaacttgctgacaggagtctgatatagctgtctcttgagaggctctgccagggcctcagaaagtggaggctcacagccatccattggatggagcacagggtccccaatgaaggagctagagaaagtactcaaggagctgaaggggtttgcagccccataggaggaacaacaatatgaactaaccagtacccccagagctccctgggactaaaccaccaatcaaagaaaacacatggagggacttgaagctcttgctgcatttatagcagaggatggcctagatggtcatcaatgggaggagaggtcaatggtcctgggaaggttccatgccccagtataggggaatgccagggccaggaagcaggagtgggtgggctggggatcagggagggggagatgatagggcattttcagtggggaaactaggaaagaggataacatttaaaatataaataaagaaaatatctaattaaaaaggattacctatgtgcatgggagctcatgagcagcaggggtcactctaaggccaataatccacatagagcgatgagctgtgtgtgaacaggactctgtatcctctgtggtttcctttcttaagtgtattaactgatctgtccagctgtgattgacatgtgatgtctccatgctcaagcccagtaaagattctctgttaaataccttacagacttatgtttacttgtttttatttgcttttcatatttttttaaaaagtcatacaatgtattctaataactcattctcccatctccaatttattctaagtttttcttaactcatccaaccacacactttttaattctgataaagcacccccccccccaaaaaaaaacccaaccaaccaaaaaaaaaaaaagccaaggaatttaaaaggggattgaaagcaaataaaaactaaacaaaaaagtaaaaactacacacacacacacacacacacacacacacacacacacacacacacactcacacacacacacacacaccacacacacacacacccatgcacgaacacacacacacacacacacacacacacacacacacacacacacacacacacatggaatccagtaaaaccacaactctttacccatgatacacaggaaaatataagtcaaacaaacagaatggaagaaggtggtattataaaaatgtctgcacaaataccattaagttcattttcttgttggctaccaactgctaagcctgtctcccttgattaattgtgcttatcatcccctatgaactccattggaggacactaatttttccttctgtctccaggaattgaagtgttgcagaactctcagtagctttatttacctgcacaatacagcctctaatccaaccagtgaaaattaccacatgagagacttccaaatgaaagaacaggtaaagttgtctactggcaagcttagtaatatcatgtaaatgccttagaatttaatgacatatgtcatcctctgaggttaataaatccattttggtgcatatataccctgaactcaccactaacataatacaacaattaaaaaattccaacatggatgcagaggaatccctgagggacatttgttgatttgtgagcacaatataattattttttgggggggaaatgtctgaatgttaactctttaccagtgataatctattctattaatgtgtacataggtagcactaattaaaatcactgtgttatcaggtaatgaaacagaggaagtaggatgctgggaaacagacttttggaaggtcccaagggaaaccacagggacctagtggtgatagattatggtgagagtcctgagagtggtcatagattatagcatatttcatatgcaattgaaaatttcaaagaatgaaaatccttatgaaatatagaaataacaactttacttatgtacatatacttcatagtacaatttttacactgtgcatatttctcctgtaacatctggttcctcctattttcctttattctcctagacaatttcactgatacaatctcatgtttttgtataaatagttgtatataactattaaatacataagctgttaatgagtcttcattaatgtctgtgatttttttattgtcttaattaatactattatctctaattgcatccacattttcaaaagcaatgtaaatttcttactcatttctgttcaaaaacttctgttgttgtatcattaccatgccttagtgataaaatcctttcttgacacatctatagctattgctataatttagttattgatgatcctcctgcaataatcattgataggtaaatattttaagcacttttacttttagtcattttagtgagatttgaagtagtatataacctgttggaaaggcaaatattaattccatatatgtgaaagaagacgctaaaactaaaaacattagccacttttagatatcttctccttcttcttcttcttcttcttcttcttcttcttcttcttcttcttcttcttcttcttcttcttcttcttcttcttttcttcttcttcttctccttctccttctccttctccttctccttctcctcttcctcctccttccttccttccttccttccttccttccttccttccttccttccttccttccttccttccttccttccttccttccttccttccttccttccttccttccttccttcctttctttctttctttctttctttctttctttctttctttctttctttctttctttctttctttctttctttctttctttctttcttctcctcctccttctttttccttctccttccccttcaccttccccttccttcctctttcccttccccttctccttctcctcaatctacaatctgttaacatattaacatgtcccagagtagagcaacagactcaggtcaaacatctactgagaaatttgcccatgtagttaacatctacagcatctgtctaggggttacaaaaagtctatgggatacaattcctcagaaaggaataggatttggacctgagcatactgctgcctaacacatgaaatggcagttcttctccagctggactaggtccttaactaagaaatgcactgctcatgaatatgcaaattacccaagtctatggcagtaaatacagagatgtccacaccctgaagacaacctatggccaatgtcctctccacagtccctgaagacactgattctaactataacggtcctaaggtagcgagggatgacagattctctgttcagtgcactcagggtctgcctccacgagaatcaccatgtcctttctcaagactgtgttctgtgcagtgccctgtcagtggaaatctggagagcatgcttccatgagcttgtgagtagtatatctagtaagccatggctttgtgttaatggtgatgttctacatatcagttctctggcttaataatgaggtgatgattctatgttcctgtaacgcttcctcaactgggtcctaagtctttcttcactccatctattcctctaaggaatgatcctgaaaatcccatcacaaactataggagatgggaaccatcaaaaaacacagtgacaaagaggtgggaacgcatcagggttcaggaaccatattttaaaaagatatcgtaaataacttcttaaaagagatatagacaaatctccattaatacggagaccagaggcctaaggctaagaaccaatggtggctcaaggtctcctgctacccgaggagcaaacgtagagcagtttctaatgatttatttaaaatatagaatcaaaagtaccagtttgcaattttgaaagatttatttcagcaatgcaacaacatcaggtggtgccgagtccaacacgtcttatgtcccatgatataaacaaaggccatccagaactgtggactggagttctaccttgtcccctaatgacattcagattttttttccattctctttatcttagaggagacagggggctaactcattttacttgtcctttgcttgttcttgccaagaacgtaaagcagcttgcaagtcttcaaacctaaatatcttagtaactcctacacgagtggcaatgccaaagagcagtgcaacaaagaggaagtaaatacgaccaaagagtattcttaaatacactactggctctaggttctgttttattatgcgcctttgaaccggaggggacccactgtctatgctcccactgtgtccctcttctttgcactttggagggctccaaccaaaatggcaatggcaattccgacgattgttacacactcctctgaaattgcatttttctggggtgcagtcataacccaaacgagataaacttccattgcaagctcctcgatcacagaacttaccccttgaacacggggtaccatgtctcaccaatccagcatctgctgtttctgtcccacgatgttcatcaagcccaaagcaggtaaccccagagataaccgattgatggaatgaaacatgttcttgcaaaaatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccctcttctgagcatggtgtcccatcttgcagataagtgtcatctgggcaaatgaacttagagccactacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcattgttatctactttgaagtttccacaaaacttataagtcaatgatgtattataataaacatgacggtcatagaaaagacatggcatcagatcaggagtattaagtatgttgcttatctctgcaagggaacaattgctgaaagcatctgttaattgaggatttttgaacatgatgcaggtgttccttctctggcagatacagtacccctcatcatgttttaggcctaaactccttccaacacgattggttattataatagataaaaataaaggatttcgaccatgttgaccaagacaaattagggctgagggagaacatatactcctctcagctggattaacagcatcatctcctggcgaattcttgttaattatagctcctgcatcaggcctaaaatgagcataaaatactctctcatagaaagtatgagcctgccctcctggaactcgaaaatcttgtgaaaatggatcagcctcggtatacacagtcatgagaaagacatagtaccgcatatgaagattggtcagataggtgtccattaaactaatgactttaaacaaatactcaacagtagatgaaagtttgtcacctccagaagcactatatacagaatgggttgcttgaaagtggccttttatagcagctggatgtgtagcgtaattcttactagatagtctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggttatccaactttatgacccctgacaggcccccataacaagtatccacagtgaccatggattgcaggatcccctccaggtagccaatatagtaacaatctacaggaaaaaaggggtactccatctgtaaggctccttggtcatcttgagttgtcagcaacaagtgtctgggccaaatgagtgtctttctccgcaggtggatgatatgtctctggccccgaaaacgcaagctatacgagagcagtctttgtgcttgaagtcctttggtatggtagatctccttccgaggaataaccacctccgatgagatgtaacgccaagtgggatggccttgagaacaccagactggaaccaggaggagcagccagagtgcaaatagcaagaggaggaccctggggaccacaggtctttccactagcctcatgccccaggtcagagataacatcctgggtggagctaactccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttttcacagttgttctaacttcttgttttgttttgtttgtttgtttgtttgaaagttagaagtaaatactgtctatattagccttttagctataaatgattgtttttatttcttctaatcatgttttgtttgagttttggttaaactatttacaaatgagttttttttttccttttgggtgttgctcgaaagtttggagctttctgttaatattgtgttgttgtttctccaatattattagacctgagaattctacctgggtacctgtgaactccagaatttttaaaaattccatctcttgggaacattatctctgaccccgtctgaggccgaagtggctgtccccctccaacctttagtatctttctttcctgactattgggatttcttcaagcaatcaggctgatgggttctcagcagtgagaccagtagactgtcggtatgaacgtcgaagagtctgccacacactccgggttcatcaacagtgctttcgcgtctcttacttttgtagaaggaaatgcagcctctgagttttctccaagaaatcattgatgaaagggtgaaaagatgggtatcacccggagttcatgacaagccctggctcagacacgtgagcaaggtctacagccccaaagataggctgccctgcaacatgtatttataagataggagaaaaaaatgggtagttggagggttgatcaacttacttcctctcaaacatatatatctcatctaagtgtgcaggggaaaactctgtagaactactgggatacctgctcacccccaggagcctcatgaataagtctctgcttctgccttgtagccatgagcattactgcacctgatacccctgcagcttcctagggaagagggaggaagtgacttggcccctgtctggttaaggtaagaggagataaatcccttctcattgattagggtgagaggggtcatgtgctctatcattggtgacccagttgggacatgggtttataccaaagtcatcactctgaggttctgtgtaccaccaggctgaactcccatatcctacatggacataggacaacaccaagcagaaggaggttttaggactaaactgaaggacagagatgcggtttctaaacaactagggagtgccagggccagcctctctaaccactataggacactgtggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaagggagggagggagagagagagaaggctaagtctttccatacctgggtcccaatacctcttataacccaagcacatggtttcacatatcacaatgcggttgggatatagataactgtaaatacttgtgaaaataatggggctgagatctggggttttcatgatagtttcaaagtcaccgtactgactaaaaccttccactggcccatctccagcttcctaatctgagggtatcaaatttcccactaagtgtgtttagaaagatctccacctttttgcccttgtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaaaggtaggcatgtagaagctgaagcatctcacctcattccaagcaccctcagtctctaaatgtgcccccttgtttccagaagtgcaacctcaagcatcttttattcattcatcttagagggccacatgtgctgtagtgttataagatgaaatttaaagcattaattattcctaacaagccaattaaacaagccaaaaacattcatcagtcattcccatggaacctctgaagcatcttcctgctctaaccttgggttttccagggctgctctgggatcacaggagctgtcctgtctaccagccatataaaggcagacctatcagaattacaccagacttctcaccatagactataaaagccagaatatcctggacagatgttatacagaaactaagagaacacaaatgccagcccaggctactatacccagcaaaactctcaattaccatcgatgaagaaaccaagatattccattacaagtccaaatttacacaatatctttccataaatccagccctacaaaggatagcagatggaaaactccaacacaggtaggaaaactacaccctagaaagagcactaaagtaatcatctttcaacacactcaaaagaagataaccacacaaacataattccacctctaacaacaaaaataaagtaggcaacaatcactattccttaatatctcttttaacatcaatggactcaattctccaataaaaagacatagactaacagactgaatacataaacaggacacagcattttgctgcataaagcaaacacagcgttacttttttttttctaaatgacattttttattagatattgtctttattgacatttcaaatgttatcccctttcctggtttaccctctgaaatcccctatctcctccccctccccctgctcaccaatccacccactcccacttccaggccctggcaatcccctatatttgggcatagagccttcacaggaccaaggtactctccttgcattgatgaccaactagtccattctctgctacaaatgcagctagatctatgagtcccaccatgttttcttttgttggtggtttcatgccagggagctcttggagtactgattggttcatattgttgttctccctatggggttacaaaacccttcaacttcttgggtcctttctctggctgcctcattggggaccttgtgcgaagtccaatggatgactgtgagcatccacttctgtatttgccaggcactggcagagcctctcagaagacagctatatcaagatcctggcagcaagctcttgttggtatccacaaaagtgtctggtggttgtctatgggatggatccccaaaggggcagtctctggatggtcattccttcagtctctgttccacactttgtctctttaactccttccatgactattttattcctccctctaagaaggaccgaagtattcatactttggtcttccttcttgaaattcatgtgttttgtgaattgtatctttgatattccgaacttctgggctaatatccacttatcagtgagtgaatatcatgtgtgttcttatgtgattgagttacctcactcaggatgatatcctccagaaccatccatttgtctaagaatttaatgaattcattgtttttaatagctgaggagtactccattgtgtaaatgtaccacattttctgtacccattgttctcttgagggacatctgggttctttaaagcttctggacattaaatataaggctgctatggaaatagtggagaatgtgtccttattacatgttggagcatcttctgggtatatgcccaggagtgctattgctggatcctctgatagtactatgtccaattttctgaggaactgccaaactgatttacagagtggttgtaccagcttgcaattccaccagcaatggagaaatgttccccttcctccacatcctcaccaacatctgctgtcacctcaatttgttcttagtgattcagacaggtgtgaggtggaatatcagggttgtttggcatttccctgatgactagtgatattgaaaaaaattttaagtgtttctcagccattcagtattcttcagttgagaattcactgtttagctctgtactcaggtttttttaatagggttatttggttttctggagtctaacgtcttgaattctttctatatattggatattagccctctgtcatatttaggattggtaaagatctttcccaatatgttggctgcctttttgtgtcctttgccttacagaacctttttaattttatgaggtcccatttgctaattcttcattttacagcacaagccattggtgttctgttcaaaaatctttccccctgaaccctatcttcgaggatcttccccactttctcctctataagtttcagtgtctctattattgtgctgagggcgatcgcaccggtgaaaccctaggaagttcctatactttctagagaataggaacttcggaataggaacttctctaggggctgcaggtcgaggtctgatggaattagaacttggcaaaacaatactgagaatgaagtgtatgtggaacagaggctgctgatctcgttcttcaggctatgaaactgacacatttggaaaccacagtacttagaaccacaaagtgggaatcaagagaaaaacaatgatcccacgagagatctatagatctatagatcatgagtgggaggaatgagctggcccttaatttggttttgcttgtttaaattatgatatccaactatgaaacattatcataaagcaatagtaaagagccttcagtaaagagcaggcatttatctaatcccaccccacccccacccccgtagctccaatccttccattcaaaatgtaggtactctgttctcacccttcttaacaaagtatgacaggaaaaacttccattttagtggacatctttattgtttaatagatcatcaatttctgcagacttacagcggatcttcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatggtggatggtttagttcctcaccttgtcgtattatactatgccgatatactatgccgatgattaattgtcaacaattcgagagacccgggttcccaatctagagctcgacgtctaacaaaaaagccaaaaacggccagaatttagcggacaatttactagtctaacactgaaaattacatattgacccaaatgattacatttcaaaaggtgcctaaaaaacttcacaaaacacactcgccaaccccgagcgcatagttcaaaaccggagcttcagctacttaagaagataggtacataaaaccgaccaaagaaactgacgcctcacttatccctcccctcaccagaggtccggcgcctgtcgattcaggagagcctaccctaggcccgaaccctgcgtcctgcgacggagaaaagcctaccgcacacctaccggcaggtggccccaccctgcattataagccaacagaacgggtgacgtcacgacacgacgagggcgcgcgctcccaaaggtacgggtgcactgcccaacggcaccgccataactgccgcccccgcaacagacgacaaaccgagttctccagtcagtgacaaacttcacgtcagggtccccagatggtgccccagcccatctcacccgaataagagctttcccgcattagcgaaggcctcaagaccttgggttcttgccgcccaccatgccccccaccttgtttcaacgacctcacagcccgcctcacaagcgtcttccattcaagactcgggaacagccgccattttgctgcgctccccccaacccccagttcagggcaaccttgctcgcggacccagactacagcccttggcggtctctccacacgcttccgtcccaccgagcggcccggcggccacgaaagccccggccagcccagcagcccgctactcaccaagtgacgatcacagcgatccacaaacaagaaccgcgacccaaatcccggctgcgacggaactagctgtgccacacccggcgcgtccttatataatcatcggcgttcaccgccccacggagatccctccgcagaatcgccgagaagggactacttttcctcgcctgttccgctctctggaaagaaaaccagtgccctagagtcacccaagtcccgtcctaaaatgtccttctgctgatactggggttctaaggccgagtcttatgagcagcgggccgctgtcctgagcgtccgggcggaaggatcaggacgctcgctgcgcccttcgtctgacgtggcagcgctcgccgtgaggaggggggcgcccgcgggaggcgccaaaacccggcgcggaggcctcggaggccagacgcgcgagaagttcctatactttctagagaataggaacttcggaataggaacttcggtaccgcgatcgcgatgtgggaacgcttcagtgttcaggaaccatatgatttatttaaaatatagaatcaaaagtaccaatttgcagttttgaaagatttattccagtgtaagcattagcaatgcaccaacatcaggtgatttctgaatccaacacgtcttatgtcctcatgatattaaaaaaaaaaaaaggccatccagaactgtgaacttgagttctaccttgttccctactgacattcagattttcttttttgcattctctttatcttacaggagacaggaggggagggctaactcattttactttggcttgtcccttgctggtccttgcccagaacgtaaagtagcttgcaagtcttcaaatctaaaaatcttagtaactcctacacgagtggcaatgccaaagagcagtgcaacaaagaggaagtaaatacgaccaaagagtattcttaaatacaccactggctcttgtttttgttttattgtgtgcctttgaactggaggggacccactgtctatgctcccacttagtccctcttctttgcactctggaggcttccaaccaaaatgacaatggcaattccgatgattgttacacactcctctaaaactgcatttttctggggtgcagtcataacccaaatgagataaacttccactgcaagctccttgatcacagaacttacttttggagcagggggtaccatgtctcaccattccagcatctgttgtttctgtcccacgatgttcatcaagcccaaagcaggtaaacccagagataatcgattgatggaatgaaacatgttcttgcaaatatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccatcttctgagcatggtgtcccatcttgcagataagtgtcatctgggcaaatgtatttagtcccattacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcatcgttatctactttgaagtttccacaaaacttataagtcaatgatgtattataataaacatgacggtcatagaaaagacatggcatcagaccaggagtattaagtatgttgcttatctctgcaagggaacaattgctgaaagcatctgttaattgaggatgtctgaacataatgcaggtgttccttctctggcagacacagtacccctcatcatattttaagcctaaactccttccaacacgattggttattataggagataaaaataaaggatttcgatcatatttaccaatacaaattagggctaaggaagaacatatactcctctcagctggattaacctggttatcttgtggcccatacttattaagtaaaactcctgcatcaggcttaaatttattataaaagactgacacatagtaattataagccgaccctcctggaactgcaaactcaagtcgaaatggatcagaattggtgtacacagtcatgagaaagacatagtaccgcatatgaagattggtcagataggtgtccattaaactaatgacttgaaacaaatacccaacagtagatgaaagtttgtcacctgcagcagaattatatacagaattggttgcttgaaagtggccttttatagcagctggatgtgtagcgtagttcttactagatattctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggtcatctaacttcatgacccctgacaggcccccataacaagtatccacagtgaccatggattgtgggatcccctccaggtagccaatatagtaacaatctacaggaaaaaaggggtaatccatctgtaaggctccttggtcatcttgagttgtcagcaacaagtgtctgggccaaatgagtgtctttctccgcaggtggatgatatgtctctggccccgaaaatgcaagctatatgagagcagtctttgtgcttgaagtcctttggtatggtagatctccttccgaggaataaccacctccgatgagatgtaacgccaagtaggatggccttgagaacaccagactggaaccaggaggagcagccagagtgcaaatagcaagaggaggaccctggggaccacaggtctttccactagcctcatgccccaggtcagagataacatcctgggtggagctaaatccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttctcacagttgttctaatttcttgttttgttttgtttgtttgtttgaacgttagtagtaaatactgtctatattagccttttagctataaatgattgtttttatttcttctaatcatattttgtttgagttttggttaaactatttacaaatgagttttttttttttccttttgggtgttgctcgaaagtttggagctttctgttaatattgtgttgttatttttccaatattattagacctgagaattctatctgggtacctgtgaactctagaatttttaaaaattccatctcttgggaacattacctctgaccccgtctgaggccgaagtggctgtccccctccaacctttagtatctttctttcctgactattgggatttcttcaagcaatcaggctgatgggttctcagcagtgagaccagtagactgccggtatgaacgtcgaagagactgccacacactccaggttcatcaacagtgctttcgcgtctcttacttttgtagaaggaaaagcagcctctgagttatctccaagaaatcattaatgaaagagttaaaagatgggtatcacccggagttcatgacaagccctggctcagacacgtgagcaaggtctacagccccaaagataggctgccctgcaacatgtatttataagatagaagaaaaaaatgggtggttggagggttgatcaacttacttcctctcaaacatatatatctcatctaagtgtgcaggggaaaactctgtaggactactgggattgttattatcattattattattattattattattattattattattattattattaacttaaggcattttattagatattttcttcatttagttttcaaatgttatccccggaacctcctatactctctccctgccctgctccccaacccacccactcctacatcctggccctggcattcccctatactgtggcagatgatcttcgtaagaccaagagcctttcctcccattgatggcctactaggctatcctcttttacatatgcaactagagtcacagctctggggaggtattgcttagttcatattgtttttcctcctatagggttgcagatccctttagctccttgggtactttctctagctcctccattgggggccctgtgttccatccaatagatgactgtgagcatccacttctgtatttgccaggtattggcatggatcttactgcaccttctgaactctctaagcagctttcctggtcggcgcgccctggcatggaggaaatgacaaagattattagattgaagactttctcagaaaatgatattaagtcattaaggaaaaggaacaatataaacgtgtatttgagaaattttaattatttgagagatttttcatacaatatttattctgcaagcaaatttcagggattgaattaataaaactgatacagaacttcctctgtaggtatctgtgtaaacatcaatttctgaatcagtgttgtaaatattttggaacacacacacaaatcacattttatctctacttttatctctatttttaaaaatgccaaaaaaactcattttgtgcatgtagcattttgaattcccaccatcaatgcatgatagttcttggttttccacattcatattgccatttatcattatgagaattgtgtgttttaaccattctaataggtgagtaatggtatctaatttttagttaaatgcacatttccctaataaaaattcacatttaacaattttcatataatttttgccaagatgcctcttctcatatttggttcatttttaactgcattgttttcttttgattagttgtaagtttacttgcatattgattataaaatcatttaacaaattaaaagaattcatttaacaaatatgtgacttggaagtattttctccaagtctgcggctgtcttttactcccttatcagtatgtattgcagaaaagtgtgtgtgtgtgtgtgtgtgtgtgtttatacaaatttagatttaaaaaatgtaaaatgttattcatccacagatcatgtctttggtattatatctgaaatctcattataaaatacagtaatagcaattactttttccacgtctctaatctcaggctacaatcaactcatgagtgtttaagcttcacctacttgattagaggactatcaacctaacatatttggaatacttctgtaaaaagatgtgttcctcttcctattatttctttatttgatcacttattaatatgtgtattggtttatggatgtctatttcatactctgaagaagatccatgctacattattcattttatttttcaaaccaccacggctttattatgtgctgggagctcattgagtttggatcctgcatccttacagctcacctcatgcttttgtttttgaacacttccctgtttcctgctattataataaattctaaactcattttctatattatctttttcatacatagaatcagccatttttctaaagattgcttgcttctgatgttaaagaatagtatttaaaaaattgtaatactgggtatgtgcattgttaatgtggtataagtacttgcaggacctctcaaccaactggcctagtaaactatgtatctaaccttctgtaatgtgattacattaaaaatgagaacacactggtctctctacccaattatgctaccacatggatctttctagccttccttccttgactgtctataacctctcactgcaaaatgaggaaccccatccaaccatatgccattttattacttagctgcacaatttcaggacacatgcatagcagtatcagaaatgtaaagctgtacccttgtaggaaacatgtttatctactagaatagagtgcttatgttcagtttctttacactttaaacttacagagtttcctcattttcaaagttccttaggtcagcaacttcattttccactttcttcagtgaggtcatttcaatgacactgtataatttgatttatttgaaattctataaaagccaaaactgtagtcaagtgaacaacaacatatagaggatattcgaggagtttagagactggtataaaataagttaaaaagacactgtttaagaagattaaaattatttttagtgatatgcaatggttcagatatgacacaattaatttgtctaagcacatagttttgtgatggaaaatataaacctaaatatatacaattaaaaaaaaatttagcagttcattaacccaaggatcaaatgcagattgtataaaattatctcattacttattttgtgagggtggagatttcatgagatgtatgcaacaaagaatgaggtaattttcctgatttgcatataagatgttgccattcactaaagacctttaattttttaaattgttttttttttaaatcaattttctatgtgacccaggtttttttctcttgacaagcaaataacccacaggattattttctttccttggttgagaaatatttccccaaacttcagctcagttcaggcatacactgtccctgaatgggcatttaccctcagatgggtacacacacctgtcaacatgtggactcttctgtcagacaaacgcacctttactcacgtggattcttctctcagacaaacacacatgtccccacgtggactctttcctcagactaccacatatgttcttacatttactctttcctcagaaaacagacatttcctcatgtggactcttgtctcagacaagcaaacatgtctccatgtgaactcttcactcacataagtacacatatgtccacattgactgtttccttacacaagtacatatatccaatgtcgaattgttctgtggcaaaatgatctcaagataatgataatcataaaccccctccctgacaaggcatagatctgtatttttttcattgcaacctaactttgccttattgtcaagaacagtagtttgcagctctaaatataccaattagagacaggtgtccattttctctggaaacgtatttttatgttcttactggacatatttgttgataatgtttgctattatgaagataccccaacagtgtccacattagagaataaaaaatagtaatgggcagattaactctgtgcatccagacccagaaatcctttgaccttgacttccctgaaatgtagacacagaggatggatgagcaatgctgagcagtgcacccatgaccacaaaaagaaagacgtggaaatgtgtcccctccacttctcatgaaaggcagctcatcccctgttccctcaggccctggcgaggagccaccccatgtctgtgcccttcctcagtgtccacaccgtggggtctgcattgatctggattctcttctcatccccgtcaatattagtgtccttcgtaaatcaggtccagctgtggcttctcctcacggggctgttctcagtctgtttgctgtgttcacggaagtcctgtgtgaagtttactgatggagtcagagggggaaaaaatttacagcccagtggtgagactctcctgcaaagcctctggtttcacctttactggttacagcatgagcttggtccagcacgcttcacaacagggataggtgtgggtgccaacagtgagtgatcaagtatgaattctcagggttactttccatgagtacaaataaattaacaatctcaagcaacacccttttaagtgcagtctgccttacaatgaccaatctgaaagccaaggacaaggtcatgtattactgtgagtgacacagtgagggaaaccctgtgtgagcccagacacaaagctcaccgcagggagacaggaggggactatgtggtagatgctgctcagaaccaccagggggcatcaggaccatcagggagggtgcacagaaccaccaggaggggctcaggacaccagggggcgctcagaaccaccagggggccctcaggacaccagagggtgctcagaaccaccaggaggcgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcgctcaggacactagggggcgctcagaaccaccaggaggcactcaggaccatcagggagggtgcacagaaccaccaggaggtgctcaggacaccagggggcgctcagaacactaggaggtgctatgaatcactagggggcgctcaggacacaagggagcactcagaaccaccagggatagctcaggataccagggggcactcggaaccgccagggggcgctcaggacactagggggcgctcagaaccaccagggggcactcaggaccatcagggagggtgcacagaaccaccaggaggggctcaggacaccagggggcgctcaggaccacaagggggccctcaggacaccagggggcactcggaaccaccagggggcactcagaaccatcagggagggtgcacagaaccaccaggaggggctcaggaccaccaggaggtgctcaggacaccagggggcgctcagaacactaggaggtgctatgaatcactagggggcgctcaggacacaagggagcactcagaaccaccagggatagctcaggacaccagggggcactcggaaccgccagggggcactcaggacactagggggcactcagaaccgccaaggggcgctcagaagaagcagggggtgctcagaacaccagagggtgctcagaagcaccagggggcgctcaggacaccaaagggcactcatgagactgtggcaagggggtgctgagaaccacaggatgtgaccaagacaccaaggggcactcagaactgccagggggtgctcaggacaccagaggattctcagaaccaccaggggatgctcaggaaactagcgggtgctcagaaccaccggaggacactcagaaaaccaggggatgctcaggaaccaccagggggcgcccacgacaccagagggcagtcagaaccaccggggcatgctcagaaccaccagggggcgctcaggacaccaggggatgctcaggacactaggggcgctcaggaaccaccaggggacgctcaggacactagtagggtctcagaaccaccaggggatgctcaggacactagggggcgctcaggaaccaccaggggtcacccaggacaccaggggtcgctcaggaaaccagagggtgcccaggaaaccaggggaggttcaggaaccaccagggggcactgaggacaccaaggggtgctcagaaccaccagggggcgctcaggaaccaccagggggcgctcaggacactagtaggcactgaggaaccaccagggggcgctcaggacactagtaggcactgaggaaccaccagggggggctcaggacactagtaggcactgaggaaccaccagggggcgctcaggacactagtaggcactgaggaaccaccagggggggctcaggacaccagaggtcgctcagaaaaccagggggtgctcagaaccaccagggggcactcaggaaccaccagtgggtgttcaggacagcaagaatggctcaggacaccagggagcactcaggacctccaaggggctctttggaggcagctccatatcaggtacctggggaggatgaggtttccttttccaccttggtgattcctgacctggtcaagcaaaagtcttccccaggatctcttacgatgtcttccttgtaactcatggtttctttcacctataaaacattaacttagaacaggggttcaattcaacttttaactctgcctattttcagagttatactagcaatgatatatctcagtatattttttttaattgtgtatattcaatccaaagtctggctctatgcacaatttttttgttttctgtgctgtcagacacactattgtaaatgcttttctaacaactcagcatatgcatggggtccagtttcttttcctttcatcggctgtttgtgcagatgaaacaccactttaagggctcctgtcctccactttggcccctggtgttctgcttctcaaactttctccatcttctctttttctgtcaaaatattttatcttcctcagtctccatgcaggaaacaggaagtccttttacttcctgtcctccatgtctggtaaatcagttcacttcttttcatgatcactgaagccaaccaagtttaggagagtaacagttctccttagaatacactctacctgcagaccctctgccctcatcacacttttctagggtcctgcagacataacccccacccattcctctttttccctaagtaccacagactaggctctgcaacttatgctaccctctgtgtgctcagcccaggggctcagtagtgctttcatgaagtccaaatccctaatgtgtttgcccactctcagaccaccctccagcaagctgccattgtgattgaatcctgcaaagcatgggctgctttcagtttcctattgctggatgttctttattataaaggcatattggcaaataacgactagagtttgtattgaaaattaacgccaaaaagttttttaaaaagtttttcaaatagaaaagttctatcctgcctagtttaaaaaaatacaatgttactttaatcaatgatttaataaaaatttaagtgatgtttgtcttattagttattcaatttattaataactgactgatatttaaaaagtaaatactggctgggcgcagtggctcacgcctgtaatctcagcactttgggagggtgaggtgggtggatcacctgaggtcgggaattcgagaccagcctgaccaacatggagaaaccccctctctactaaaaatacaaaattagctgggcgtggcggggaagctgaggcaggagaatcgcttgaacctgggaggcggaggttgcggtgagccgagaacacgccattgcactccagcctgggcgacaagaccaaaactctgtctcaaaaaaaaaaaaaagtaaataccattgtacacttaagtaatatatttggcaagaatggcatttacattcattcaaaaatgaaactgcaaatacgagttacattcaattaaataattaaaataatatagaaaaaaatgggtgtgttgttttggtgtttaatatacattcatttttgcatggacgggtatatgtgtcattgctgggctgttgtgtatgtgtgcgtgtgtgtgtgtgtctgtgtgtacaactatgaagtttaaaatatattattaaattacgtagttatattaatccaaatttatcatgttaaaatattaggaaaaaaacaccagtagagaaattacagagaacatcagcaatgcctacagcatttacaagagtcacattaataacaaacaaactagttcaaatgtttagatatgacacatgcagtagaaaacgttcacatggtattaacacaaaaatggtgcacaactgaggaaattataatacgttcatgatattggctacataaatgcttatgatagtaatgcttttcatccatcaaatgcttatgataatgcttttcatccatcatattatagatgataaaacaactctataaacacttccatcactagcgtttaatatgagatgcctcacatctttttctgaaataaataaacatctgtccaccacttcgatgatcatttcaggattatcctctgaaataattatccataataattttagtaacaatattattttcagaagcctattttataaggtctttgaactattatttttatgattgttactttatattttacacactttttatttggaataattataggttatcagaacaattgtaaggaaaatacagtgtgttcacatccatctccaagttttcactaaagttaatatgtcaaaaaaaacatgggacatgggactaatatatttacattgataagtttctgtttattcagctctgggatttatttgaattttgccaatttttaacagtttccttttttcctttttcttttctttttgagataaggtgtcactttcctattgctttttgtttgtttctttgttcaacccacgtaaccacatcaaattcagtcaccatgttcctctcatatcttctggttaatcacagtttgggttcctgctgtcttcccattgaatattctataaatgaaactagtcaaataagttgattctggtcacttatatatttacctattttatcacgtttgttttgtcaatcacagtaagtgtcgaattcgctatctgttatagatgttagcctattttctatcccagatccattggttaaatctttggtgatgccttttagaaaactgatccctttaccctatgtaatatgccccttgattcctgaaagtcttatgtctaccttgtctgaatttaacatagctaagcacgctttcttttcgttcatattttcatggtccatgttttcctgtatttaacttttctatgtagagcaaatttctgtacagagctagtagttgggtcttgctttttaaatcaactataataattctattttaaaactggtattactatttttctgttaatttctgttttaatttggcattttatgatcatgtttatttctctattaacttattgtttagttcatcttttatgaatattgtattggccctaagatatacaataagaattgtgtataatcagattctaattcaaataacgtaaaacctcttcataggttgtagagctattataacttattcttctaaacactctttctcatccgttgtcttagtttattctcagtttgcacttatatgtgctataaaatataatatgtgcatttttatcattacatagacatatattagaacaattaaaaatataaaaactacatttcaacttcattttttcattcttgaccacatgttttatttggatagattcatgtttcggatgtatatcatatggctactcaccctggcagaaaatttgccaaagcacctactgaaggatgaatgcactagcaataaattttctcagaatcgatttgtcttacagggtattcatttgactttcgctttaaatgaaatttttaatatatatagaattccagtttgactttaatttgtaatttattttcttgtactcatgtattcattattttcttcctgaagatggtcacacattccattctgctgggccttcattatagatatttgtgtgtatctattcagggctatatttgcaatttatggatgccacaattatcagagttgaagtcagcttctgctgtccacagagatttcaagttcctcccatgatacttgcttttgtgtccctgtttgatcctgggtctttatatttagttttccccagggaggctgtctgtttcagctgtggaaagtgcaccctactgacagtttaaattgatgactgtgtggtgaaggaggttggacaaagcgggacttcctccaaccttctgactgagtctccttcttatgcaggagtagtaagcatagttctggggagtggccttccacattgtcctgtccttaactctttccccagggctggaacgtcttttcccagacacaactgtttttcaccagtgtccccagctttttacccactatccttaccctaaagagtaaggatttctttcctgaggaaggagatgggaggtgtttctggatcaagtttccttggtgtcgtctgtttccttttgtttctgttgacttcaccacagctcatatgacacatgctttggtggatttcccctggaggtagtggaggtgcattcaggcattccacaggagctgctgttcttttccccagtcaacaccacaagacaccagatgaggaagttgtccgtggatttttcaagttctctaggaaaagcttgcaagcactaggccaatctaacaccattagtacatgcatactaaaaaaaaaaaagtcattaagtatttctaggttagtctgtttctatctcaaatgccatccagtggcacctgccctacgtacactagcaggtaggtcctggttctctctgcaggctcctatcttctcagatttcagttttcttgtttgcttggtgaaatcaactcagatatgttgaatgttttttctctcttttatttgtagctgttcagcttcgttgttaatgaggtcagaataaaatcacagttttctcatttttttcacattcccacactgaatagctgctttccgtataaaagccagaaactgagagaacacattgaatatccattacaggtgaatgttaaacaatttgagatatgtttgtgtactggaataaaatgctgcattacaatcaagtcatcactcattcacataaaacatggccacattctcaaataatgtagggacctgagtgcccctccatctactggcctctcctggggccctagcctggccacaccttcttgcagggcagtcttggacgccctgggatcccgcaccaaaatttctgccctggcagaacatgcctgactggtggagagctccaatcgggcagccctcatgtgcacacaccagcttacacacttcctccgaatactgtaggttcacccaggcccacgtaacttcccacatcactttgcagtcacatgtctgtataggtgggttttgcttttcttgtcccaccattgcgtggagtgcagtcccctccccccaccccaaccaccatggcagaggaagctttggtggggaaaaagccagggccgctcctgtcagcgtcccgcacttgcgctaattctgcacagagaatagcagatcatctcacacattcagaaatcactcctgcttgtggggcatgaatacggcacccgggcctgtgcccacaagtgtcccatccctgagccaacacctcctccagtgtgaccttgaacacagtcaccaacagggccccacagacgcaatgcctctgccactgtggcgaacacctgcagggaggcaggcacccagacacccactagcactctgccacagctgccacacctccaacagcccaggacagtggattcctaaccttaaggagccggagaaccaagtcagggactagtataacttcccccagagtcagagcacacagtctaggtgttgggagctgagcactggccacctaaatttttccagaaatgaagccagttggctgaatccaccttataccacaatcaaaccctcaaggtcatccaatagggtaaaagaaaataaaaatgtatccaaaggtcagcaacttcaaagattgaaggtggataagcccacaaagatgagaaagaaccagtgcaaaagtcctgaaaacaaaaagggcgccctctttcctccaaacaaccacagcacctcttcaacagcagttctgaatggggctgagatggctgaaatgacagaaacagaactcagaatatggagagtgaaaatgtagatgaatacagctatttatggagaatactataaatgttcctcaaaaaataaagaaacaaaatctactgtagaatccagcagtctcactgctggctatgtatccaaaggaaatgaaatcaacatgtcaaagagatatctgcactccatgttcacgttcattgcagcattatttaaaatagtaaagatatggaaacatcctaaattcccatgaatggatgaatgaataaagaaaatgcatacagacacaacagagtaatgttcatccttaaataagaaggaaaccctgcctctgtgacagcatgcatgaatctagaggaccttatgccaagtgaaacaagccaggaacagaggaagagtcattcatgatttcactgtatatattaaagcagtagacttgcagaggtagagtagaatgttggttaccagggcctagaggggtggactgggaaagggagatgtgggttaaagtgcacaacgttccagttagaccggaggtataagttatgcctttctaatgcacagcatgtcaactatagctgataaggtagtatatatttcaaaattactaaaaaaataaacattagaatttccccactaagaaatgataaatttgtgaggtgatgaatataagcggcttgagttacccagttcataatgtatacatgtatcataactaaacaacatatgtcataaatatatgcaaaaattatttgtaatttataataaaataagtttcatatttaaataattacattaagaaaatgaacagaaactttcagatttcaagaatattttatatatatatatatatatcttaaaacaaacttgcaacagaatatagaaataagttttacgactcaatggaaaagaacagaattcaataaaaactggctaaaagaaacaacagctgcatcattatagaaaattctggaataatcagccatataaagattctcactctcttagaactagaattccgtaggacttgtaattcctcctgacctgggtgggaggcaaaaggaagaacagctaatggtgattcagtgagttttatacctgtgtgtacttctgtgctcactcagcagaaagaaaagaagaaaagaaagaaagagagaaagaaagaaacagaaagaaagaaagaaagaagaaagaaagaaagaaagaaagaaagaaagaaagaaagaaagaaagaaagagaaagaaagaagaaggaagaaggaaggaaagaaaagaaagaaagaaagagagagagggagagagggaaggaagggacagcagaagtcattgtggtgtgtgtgaaagcacaatccttgggctcccccacatccatctctactccagtcccatcaatgtccagcaaatacattttctaagatgaagtattttaaactttctaaatcctgctagaaaacccctcagctctttcagttttgctctatcacttgaattattgaattaaatctagtttttgtgggcctatcaataccataagccaaaataacacatgaagaaattgcactgagacacatgaaaaccttctgaaagctccataatttcagatctgcattcttatttccccgaacctaaatcactgaatagagactcagaacgagttgatcttgttcctgaacgtgcacagagccaaggacatcctgtctgtctggaacagctcaggtttgttcctgtttctcctagaggatataaaatcttgagttagggaaaaacagccagggacaccctgggctttgttcttctctcccctggaggcaggatgtccttcagagctttgtcccagtgggtaacacagctgctgaggtgtacaacccacgtggcctcgttttggtcacttttgcatggtgagcctgctttgcaccatggcctacaatatgcgtgtgtaactaatctgtctccatcttcaaaatgacattattccacatcaaatctagtgcaggtgcctcacacagaacattctcaattacctccatcattcataaaattgatgccattaatttcaagtatacatacatcagactcatttaacgtattgttattctcattgtttgaaacataacttttagatcaaataattaacaataataaaaatataaattttgaagtcaggtaatgtgatttctctagttgtgttctctttgctcagaatggcttgggctgttctgcatcttttgtttttccacatatattttaggattttttaaaaatttctgtgaagaatatcattgttgttttcatagggattgtactgagtctgtagattgctttaagtattatggacattttaacaatattgaatctttgaattcataaacatggaatattgttccatcttgtgtcctctttatttcctcaatgttttatagatttattgtagtttttttttactttgttcattacacattgtatgcctgtaccaaaacatcacatatacccaacaaatagaaatatatatactattatgtgcttataacaattaaaaattatgtatgtatattgaatctattcaaaatcagaaactatttctttttactgtttgtaaggtcttgtctctaggctataaaaagaatttgtaaaactcaacagaaagcataatataaacagaattctaaaatgagtgaaaatctgaacaaacacctcaccaagaaaaaatgttatctgaaaataagaatatataaaattgttcagtatcaattgtcataaactgatactcatatttaccaaatacaaaagtaaacatgatgtatttcaacagaattgattctcaaatatttgtatactcatacagtggaatactatcagtcataaaaactatgggttattaattcagaagacaacattttaacattttttctaagtgaaggaagatggacaaaagagactaagtattgtacaattccattcatgagacctgctaaatacagtaaaattaaaaggattttaaaaacaggtttgtgataggcagggcttttggggaaagacaagagactgacttggcaaagctcaggggatatttttagggtaaaacaaactgtgtgccattgtgatatgcctaatttcttattatatttgttcagagttaatagtgtacgtttcaaccaactcggtgattttatattttctatttgctgatagagacatgttcatttttgtcaatcactttgctaaatgtggctgagaggctgttgaaatgaacgctgagcaaatgtattcaccaaatctacaagagcaaattatttgccaattgctgattgagtggggtctataatgtatttgagattgggtgtggggatgttattgtgtgagatcatgatgtttagaccatgacactctctggtgagggatcactcattcattgcacatttaatgaaaggcaggtaggaggagcagaaggggatgagtcacactcctgaccacagccacaggttattgaaggcagaactgatgtaatcccctaaggtagaccactgcccctccaaggtgaccttatcctagagttgacacacatcctgggacaccagagacaactccttctctcccctttctctgcacttcagctggaagcaactgtctcaccgagcaccttgtgttaaggaatgagagttcctgttccaggtgtgagggcccaggtgcatccacttgatccagcacaagagcaagaacagccttccagaaaatgacatcgcctgaggtataaccagctctcacctgctgcagcttcctctgaataaaaaggaaactgttgaaacttcctcataagtgtcctgctgtgccattccctttgtccccacatgttcagttgtgtctgtccagatgtcacttttgtgtagggagattagggttctgcttccagtaccagaacacacatgacctcttaggggacttcagggttttgctgacatatgtgatgatcttaaaagtcattagctccatttctacatcaaaaaacatctgaaccaaaggagcacataggctcaggcctgtaatcccagcactttgggaagccaaggcagaggaatcacttgaggtcaggaatttgagaccagcctggtgaacatggtgaaaccccgtctctactaaaaaatatatacaaaaattagccaggcgtggtggcactagcctgtaatcccagctacttgaaaggctgaggcaggagaattgcttgaacccaggaggtggagattgaagtgagctgagatcgcaccacttcactccagcctgggcgacagagtgagcctccatctaaaaaaaaaaaaaatttatatatatatatatatatatatatatataataaatatatattatatatcatatatatattttatataatatatatgtatatttttatatattatacatacatatcaatatatgatatataatatgtatatataatatataatatgtatattcatatattatataatatgtatattgatatatattacacatatatattttgatatatatatatctccaaaccatctaaatatcaagtattttttaatccatctaagagctgaaattgctgaaaaaactactccctccaaaagctgtagagacaggcacatccacagtcacagcagagacttgctgacttggaagagaagctcctggagacacattggtgagaacatttacctggtgattatgctgaatgtctggaggacaaatgtggactagggggagggtgagcactcctagaggctgtacaccccacacttgtgtggacttgccctccagggccttcaggttctcgtggaagcaattaaaatagattccctatagccatgaactggggaggagtaatcacggagaaaagatgcacaaaaagacttttctagaaagctcatccaagggaaggtattctccaaaatcttagtttatgtgggggaaggaaatacttccaaattacagacccctcctcctcagccttcctctatcacgcaaatgataaaattagccaagaggagtcagattcaaggcggtagccctgggtgcagcatctgcagaagggaggaaagagagaaaatcagctgtatcactggagattccttgtgaaggtcactgctcaggagaagagggcaaccaaaccagggagagtcaactgtaagaacataccatgctcccctgccccacacattacctcctcaacagcatcattaatatggattaaagagggcagtgtgattgctttagatctgtttgagaaagaaagtcacatactgaggcctagggtcagggtcggcggcacttcccgtgagtaagatactacgaagaaggaaaaattaggggtccataactgtgaaaatcagccacagtgtgtgtgagaatgtttgtgtttgtgtttctgtgtgtttgagtaggagttattggaacagcggacgtggagtgagctttaatccacatccatctgcagcttcaggtattctcagatgcagtattcatctgcaagagccgaaatgagaaaagagccacctccaacccccccagagttttagcctccctttgtttccagtgatccagtgcatctagacctccaggaagtggactccctggtgattttagcgattcttctcttggagccaccctgaagaggacattgggtttccaaaggcccattcactatttcaagaagtggtgccatcagctcatgttgtcactgaaggagcattctgagccagggcacagtcacttcctagtgagctacagaggctgagagaaaaatgctctgtgagacccaatgggaagctccctgcagtgcaaggtctgggtggcagggagcgctagggcctcgcccagcacaggctgcagccctggagcaggtgcaagggaggctggggaggggttcctcccagggtctgatgtcttccttttctcggacaaacatgctttaataagttaaacaagactttagtaaagactattgatgtgtctttgtgtctttcagtatacagttctatttgtaggatttatctaacctaacaagtcaatgagaatcacatgtaaaaggagaaatttctaggattttcagatatcttaataggtaggagatggagaaaagggatggttttattaattcagtgcttgccaatcttaacagagacagtagtaagacatgcagaaagcaaagcccagaaaagtatgaaggtgtcaaagtgccatttaagtatgggttcacttggaggaccatgttctgcgggaacttgttttcagcagacaatctattttagcagagttctgggcatacaaggggacacacatcattaaacaaggattgggacagggacttcagcgtcccactgttgcatggcccataaattatgtgtgttctctttctcatcttggatcaagtctagagctatgaaatagtatccctcatgaatatgcaaataacctgagatttactgaagtaaatacagatctgtcctgtgccctgagagcatcacccagcaaccacatctgtcctctagagaatcccctgagagctccgttcctcaccatggactggacctggaggatcctcttcttggtggcagcagccacaggtaagaggctccctagtcccagtgatgagaaagagattgagtccagtccagggagatctcatccacttctgtgttctctccacaggagcccactcccaggtgcagctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggtcaccatgaccagggacacgtccatcagcacagcctacatggagctgagcaggctgagatctgacgacacggccgtgtattactgtgcgagagacacagtgtgaaaacccacatcctgagggtgtcagaaacccaagggaggaggcagctgtgctggggctgagaaatgaaagggattattatttttaatgttgtttacagtatgtcattaataaattgaaaaaaagtaacaatagaagtatatactctaattatatgggaactttgttttttcagttttttcatttttttttttttttttggtttgtttgtgacagagtctcactctgccacccaggctggagtgtaacggcacaatctcagctcactacaacctccacctcccaggttcaagcaattctcctgcctcggcctccagagtagttgggattacaggcacccgccaccatgcccggtgaatttttgtatttttagtagagacggggtttcaccatgttagctaggctggtctcaaactgctgatctcaggtgatctaccctcctcagcctcccaaagtcctgggattacaggcgtgagccactgcgcctggcccaattatatgggaattgtttatataattatcaccctataagcaaaattcatggaggaggaaaagctctactgaagaaagctgataccggcattcccatgaaagtatctgtgtagaagtaagtattaaaatcagttgaataggcaaggcatggtggctcacgcctataatcccagcactttgggagaccgaggcaggtggatcacaaggtaaggagttcaagatcagcctgcccaagatggtgaaaccccttctctactaaaaatacaaagaattagctgggcgtggtggtgggtgcctgtaatcgcagctattcgggaggctgaggcagagaattgcttgaacctgggaggtgaaggttgcagtgagccgagatcacgccactgcactccagcctgggcgacagagtgaaactccatctcaaaacaaaacaaaacaaaacaaaacaaaaaaacagttgaataaagtaccttagagtcatctgttcaattaacatgtttaactccaaagaaatactgaaaatattttccaaaaaggaagtgccattttacgttcctaccaacagtgaataagattttcttttctggagccttgtcagtattcactaatgctttgctgtgcagccgttgtaatattatagtaaatgagtagcagtatttaatggttgttttaaatatacatattcttaatacaaagtcttgatgaacacttttttatacattgttttatgaggtgtgtgttcagatctatgtatgccagaaatgcctggcagcgttaatttaagcacactgtgagaatgaccctatagtttatgaagaatgtatgttcagagctctgagctaagaaatccaggagctgtcaacccagaagtttattccttgtctgtgaaggacatctgaatccctggcctatcccttggaacacaggatgtccaggtgattgatgctctttgttaaatctggaggttgctaggtagagggtgctaagtgaaaatcataatataaactacacgtgttttacaaatggtagtggttttcctgtccaacacacttttcctgggccacattgtatgcaagtcctcaatacaccctaggtcttgttcatgggctccaggtctcctcttcagccttttggacatggtgccatgcctattacagtcaataggggtctagcatgacaactggtaggcccagaacaaggtcaaagaaaatcctgcaagctcttagacaacagtgtcaaggaaggggagacctgtggggaaatcccaggcaggccatgcacatctctgtgggcccaacagctgcaatccttgatggatggggcccgctgcatgtgtacggggatgcctccaaaatgccaaaagttctggaggacctgttgcctgaggtggatgtgacaatgtgacaaagtgacagtcagattcctgagctgtggcagctgttggccactcctgactgcactctgagcaaccactgaggcagagctcattgcacaggctagggtgtgtcagccacgagaacagttgtaactataatgagatgccgcctgtagggataggatagcaaattggagaccattgtttatttggtaggccatttaaagtgttgctgactgccacaccaatgcattaggactactatgactacgtcatcctgggagcctaagtcctggcgtccgatgtagagctccagtgggaaggagatgaaggttaggatgagtccataaaggttcttgctctgcagcccctgctttgctgtctcacttggtgaacagagaatgggaggtcaatgcggacaaagtccagggtccaggcttatcagtcaaatacttggtgtcatctggttacataagactatagttattccatatttcatcatagataagataagatgcaggtctactcatgtcccaccacaccaaagcagttggaaacctcccaaggcctcctgggacattggcgatcctttattccccatttcggcaaaccccttgggcccccatggcacttagacaagaaggtgccccactgcgactgttccaaaagggaggatgagggctctgaagaagctgaagtcacagtgaaatgaatacaaaccttgggagttctagtgcagggacagccctgtgaattggatgtagtcagttaccctgaggggtttaggtggggactgtgttaaaggcaaggacataagtgtgtgtccctaagaccctggtctcaaagacagaaggaagctgaagtgagatatactgtttaggagtagcaactgcactacatgtcatgccttacgagtgtaggatgtgacaaagagggccactccacatccggaacaacctttagcaggctggctaaaggatgccttccagacacaaaagccttggaatgccaggacacagtctgtagccaaatggtacttgtggtggtcaccaccaacataaaagtgggccaactgtgccagcagaagttagccccacagaactttcccccacctaagagaaggcagtgcaccacaatgcggaattccaccactgtggaattgggggagcttagaattggattcagacacaaggggagagagtggatcacagggtggcttctctatgggatagggggtggagagtattatactctctggactcaagatgagtaaaatgacacccatcacaaaccatccagccctatgatggcacctttatggtaagtggttgcaggctccaagggggccgggtccaatgaggaagatgcccccacagctcgttctcaatggcagactatagaagagttgcaggatatcttctgggagtcgagatgaggcatgctaattatgctgagaattattgaagtcccaacaatgaattgtttactgcaaaataaaagctacagttatgtattcagtgcctacccaatggcatggtgcactgatttccacgttaagccccctgggagggcagccaacatttcatgtgccccaggtagttgctgacttaggagaaaagaagaaactgagtaagcaagggatgcaccctactgtgatgaagaacaatggcaccaaaggaagagagacagccaaggagccagtcagggtggccagacaacgaatgtgctctaactggcaacacctaccagttctctgggcccatagcggcaataggtggttatggaagggccacggaagtcagaccggttgaactagtgatacgacctgggggactgccacccagaccctgtgtagtatacacagcttccatcctagaacacatgagaatggatatcttcttaggcgtgaccctccaaacaacggccagggaattccaacggagagttagagtggtgatatgtgtgaccaagcagaaggcaaactggatgccagtagagctgccaacccatggggagtcccacagctggagcaacaccacccgccctgggaggggaagatgatccaatcatgaagattgttaaggagctagcccaggtaggcattaggaggccactgcatggttcctacaacagacctgcatggcccatgcagaggccagttgagacatggagaatgacagtagattactgggagttaaataaggtggtctcccgagtgaatgcagctgttcctaatatctcctccagtctgacgagaataggagaggtgttagccacgtagcatttccttatcagtttagtcaataccttcttcagcatttctgttgccccagagtcaagatcaatttgcattaacctaaaaagaacaatggacttttactgtcttgttccagggatatttacacagcccaaatctcacagcctagtgacctccaacctcagtcgatgggctgacccaaaggggatacatgttttccactacattggtgttatcatgataacctctgagtcttttttcagcttataaattacagcccctgtcttgctgtctcacttgctgaatagaggatgggaggttaatacagacaaaatccagggtccaggcttatcagtcaaatagttggtgtcatctggttgggtaaaactaaagtcattccatctgccatcatagataaggtgcaggcctacccacgtcccaccacaacaaagcagctgcaaactctcaaggccttctggagcatcagtgtccttttattccttttatttgacatccctgaaggaggctgctaggggagactgtgtccctcctaaattcatgtgctgaagtcccaacccttggtccttcagaatgaaatcatacttggattagtgtcctttaaagaggtgaataagttaaagtgagattcctggagtggggccctaatgcaatctgactgttgttataagaagaggaagcaggagggagggtgcacaggccccgagggacggccatgttaccacagaacagtgagaaggcgccatctgcatgccagggagcgagacctcagaggaaacccacccagctggcagcttgatcttaggctttcatcctccataagtgtgaggaaattggttttgtattgtaagccatccgatctgtggtatttcgttataaaagccctataaaatgaatacagtaggtaataggagagcttctatacattgaaaaagtcggatggccagaaaaacctagacactcctgttcagacctgagcagggtgatggacctgctttgggacaggagaggggaagagatgaacccagcacccagacccagctgagcccattcctcagcaggccgtccctgggccggagcttgcacaggtgtgaaagagcctgtcttggtcttcaggggctcatggagttggacggagaatggtgtagactcaagaacacgtcatcggtgtgcccgtgtttatctgaatgggatgtgtttctagggtgtgctcatccccaaagaagaattaatcaggtctcttgggctaaaaagaggttgtggcatttgtgtgtattaataactgtggtcggacagtaaattatgttaaactgcttatgggaaggcacaatggaaagaaacactttgttacagaaggaaaaaaaaggtgattatttaaatgaggtgcctttgaaggtcaccatgccaagaggagcccatcacatgatagtgctggctttcatgttcaggagatcaggagggtccgtccgctggcttttatgacaccctagacagagctgagagtgtaatgtatgaatggaggggaagtggagagaggggaggccaaatgtttggtgggaatggagggtcactattggagccattaggaaatacacaagcatgaattatgctggaggacagaacagtgttcctggggaatattgtgttgctttgggagctgctgaacatacaggagtttcactgttcctagttctcaaattctctagactctctggacaacccagttttaaatattgggaatataggtaagacacattcgttattaaaaattattaagagaagatgtaggaagaaatttaaagtaatccatttggttatgaaaatttagttacagcgaactgtgatgtccgtttcttacttggaataatggaatgtaagtcattagtcatctcaacggttcatttttccataaccatcaattacaaaactgctgagtaatttcctgaattgcccaccatagaaactgacctcacatttcctcaatgagaaactgccagtcccgttgatccagcctcgttcttcccatcagggattttgtatctctgtggacgtgtggcacagtgctgcatatccatcggcatatggcctcaggaaaggcgccagcctatccatgcatgatgaagcttacttaggggatgaagcccgcatgctgggtgagccagtgccaacagctgaaagaatcaactgcctggtgtatgatgcttttatgaaaacaagcccagggcctcttgcattcttctgtattagattctctggtgaagatttttattcatttctgcctgaaattgccacatataattacctggaagcattacaataaactgatttggaagttaactgacttcctggtgaggttaaaatgagtgtcaggtgcatagtgagacagaccggagacatggatgcatagcaaacttgtgctcaccatggtttctatcttagttagggaaacttctgtaccttccttagatgttcaggcactccattgaggaccctggcataacattatttattgacagaccatagctcaaagtatagaactggatactaccaaggaggatatactattactattttatctttatcttaaaatatactcttccatctgaggtgaaaattaatccagatggtagaacttattgcagttactacagcattttagcaaatcaaaagccgcagaacaaacatatggacagatggcaggtatgttttcggaatcgtaaacaagttcgtgatgactgtaaaaccaaggggtgtctcacgagggctggaaacctctcacaatgaaacaacacaatgaggatctttgaaaagtactctgacctcctggtgagctggctgatatggaggctgagctccatgtagaaagccaaaggaatttctgcaggacgtcatcatgccaagcacagccgtaacctgggtcccagcccttttcacacgctcaatggttagatcttgggagggaatcaaagaagccatagtaaaatatcaaaatttaaaccccgattttgaatttaaaaagtgttaaaatatggttgtggcctacactcagaaaatctgtgtccttcagatggtttctcagtggcaccagatggtttcaagtggctattcattaagtttctcagtgaaattaccagacatagaataaataaattgtcactgtcttaaatcaacccatgggaaaggaaaactgtgtaaatacagcagagaggaaacattgctcaagggaaaaacaatctccagaaagtattgttaaagaaacagaggccctctttccagccagcgccgagcgatgggcacctctcgggacaactggcacaagggccgcaaagctgggggcaagagaaggccctgccacaagaagcggaagtatgagttggggcgcccagctgccaacagcaagactgacccgtgccgcatccacacagtccgtgtgcgaggaggtaacaagaaatactgtgccccgaggctggacgtggggaatttctcctggggctcagaatgctgcgctggtgaaacaagggtcatcgatgttgtctacaatgcatccaataacgagctggttcgtaccaagaccgtggtgaagaattgcatcgtgcccatcgacagcacgccctaccgacagtggtacgagtcccactgtgcactgcccctgggccgcaagaagggagccaagctgactcctgaggaagaagagattttaaacaaaaaacgatctaaaaaaattcagaagaaatatgatgaaaggaagaagaatgccaaaatgagcagtctcctgggggagcagttccagcagggcaagcttcttgcgtgcatggcttcaaggccgggacagtgtggccgagcagatggctatgtgctagagggcaaagagttggagttctatcttaggaaaatcaaggcccagaaaggcaaataaatccttgttttgtcttcacccatgtaataaaggtgtttattgttttgttcccaaaaaaaaaaaagaaagaaaaagaaacagaggcatcacacttactagaaaaacatattctatttcatatattatggggatatgacgtgatgttttgacatatgcgggcattgtgaaattattaaatcaagtaaataaacatgtccatcacctcacatacttattttttatggtgtaaacgtgtaaaatctactctcttatcagttttcaagtatatagtacattagtatcatggaagtcaccatgctgtgcaatagatcttcaaacgaattccttctatctaaccaaaactctgtaccctttcaccaacgtctcagctttcacatgcccctgacgccagcccctggtaggcaccattctactctctactctgagttcaacatttttagattgcatgtgtaagtgagatcatggagtaattttttatacctggcttatttcactcaacataaagagtcaaatgctcaacatcactaatcatcagggaaatgcaaattaaaaccacgataagatatcacctcacacatgttacaatggcttagtctcagtctgtctttttgttactataaccgaataccagagactgggcaatttctaaagaaaaggaatttatgctttatggtgcttgagtcagagaagtctaatatcaaggcactggcatctcacaagggccttctcactgcctcatctcacagcagaggtgggtgagcaagagaccatttgtccacgagagaaaagagaccatcttttattagaaattcactcctataataactaacccactccattgatagtgacagtaatccattcatgaggacagagccttcatgacttgatcacataataaaggtcccacctctcaacactgttgcattaaagattatttccagatcctaaactttgggagacacatttaaaccatagcattccattcctaatatcaaaatttatgtccttatcacaatgcaaattacattcattccatcccaattgtctccaaagtcttatccagcatcagtgcaaaagtctgaagtccaaagtctcatctaaatcagatatgagtgtgactcgaggcacaatttagcctgatataaattgtttccatctgcgagcctataaagtcaaaacaagttatctactttcaaatacagtgaacaatggggcaggtatgggatagaaattcccattccaaagctcagagagaggcaaggagaaagcggtgcctagttcaaaacccaacagggaaaaaaacattaagtcttatagctggaaaatcatcctctttaacggcatcttgtgcacactggggagggggatgggcccccaaggcctccggcagtcttgcctctatatattttctgggttcagtccactcagccgctctcacaggtgggactctcaggcctctagctctcctaggctgactggaaactctttgtggtacctccaaacccacatttctgcttggcattgtgctaagggcccagtgtggtgactctgtctctgcaacaagtcactgcccgagaccttaggctgtccttaggctgcccgagaccttaggccgtccacagcattctttgaaatctaggtggagaaagccatgccctcgtggttcttgtattctgcacacctgcagaattaacaacacatggatgccatggaagttgatgacttgtaccattaaagtgatggcttgagccacacctaggtcctcctgagccacagcatgggcagccaaggagtgctgtgcctggacaccgggaacagagtcctaaagtgcctgctagaagtcaggccatagatttccttcaaatttctcccaccatataacctcgttcatggctctgaacttccaccttacagaaggacctagggatgaacacaattcagccacgttctttgccactttatggcaaggatggcctttgctccattttccgatgagctattcttctttttctcctgagacctcatcagaacggcctttattgtccacggttctactgacattctaatggtcatcacctaaataatctctaagaagtttcagaatttcctcacagctctcttcttctgagtcctcaaaagaatcacctctagtgttctattcagggcaatccagactttttatagtctgatcctccaaattattccagtctttgtgcattactacatccacttctacattttggggtatttgttatcgcaacagccccacctcttgatactgatttttcgtcttagtccactttgtggtgcaatgagtgaataccacacactggctaaagtataaggaaaagaaatttattttctcgcagctctagaggctgggaagtcaatatcaaggtgttagcatctggcaagagccttcttgctgtgatgtccatgtggaaggcaggagagcaggtgcgaaggatggaaaggggtttaaactcattttttaatgaggaacccaggcctgtagtaactaatctgctaccacaatgagtaacctactctgacgataatggcattcattgcttcatgagggcagagccctcatgacctaatcatttcttaacattcccacctctggacactatggaatttgggattaagtttccaatacacatcctttctaaacagcaggggctttttaataggttgaccacccaaggctgcaggaggctctgaagcagtggcctgaggttggctgtcctttgtgagaatggagagaagtgaactgactcatggagacacaagtagatgaggtaaaggcattcattgcttcattacatggatggtgaggtcgattgaaggcattaacggattaaagatggtggcaaaaccgtctgaggtggagaccacggggagtccatcagaaatggaggacacgtcccaataaatggtgcttcatttccctgcaaagcagaagaaagcaaagaacaaaacacaacatcatagtgtacactgagcagtggattgagagaagagtttcctaaggcataactgacagagtggagaagacacacaaatctttgcatgatgctaacatttggactgtggcttcattatttcttattaatattttactgaaatatcgctagaaggagactgaaaatgaagtgtgaaaagttaaatgggatttctgctctatgtccttttcagatgagaggaactagggaattccagggaagaaacaataatagctgctgagcaaggcttttgcagggcaggacaaggaatccccaaagagaaaacggaaacctcagcttcactttgcatctgctcctgagccaggtcctgagcgacccctgtaggtcctgagtgcccctccgtaggttctgagcatcccttggttgctgggcgccctctggtggtgtctgagcccctctggtggtttctgagccccccgccttatgtctgatcctccctggtggtgtccgagtgcccctgctagtgtctgagccccctggtggtgtctgagtccccttcttagtgtctgagccaccctattagtgtctgaggacccctgatggtgtctgagcccccagttagtgtctgagccaccctattagtgtctgagcccccctggtggtgtctgagcacaggagagctcctctgaaggaagggtctacatggggacaggcgtgcttgtctcagggaagggtccatgtggggacaggtgtgcttgtctgaaggaaggttccacatggagacaggtgtgcttgtctcagggaagggtccacatggggacaggtgagcctgtctgaggggacagaagtgcttgtctcaaggaagggtcctcatgtggacaggtgagctcttttgagggaagggttgacctggggacaggcatgcttgtctgaggtaagggtcctcctggggacaggtgtgcttctctcagggaagggtccacgtggggacagaggtgcttgtctaaggcaagaatccaagtagggacaggtgagctcgtctcagggaagggtccaggtggggacagttgtgctcatctgagagaagcgttgaagtggggacaggtgtgcttgtctcaaggaagggtccatgtggggacaggtgtgctagtatcaagaaagggtccacatagggacaggtgtgcttctctcagggaagggtgcatgtggggacaggtgtgcacatcggagagaatggtccacctggggacaggtgttcttgcctcagggaagagtccaccttctcagggaagaagtgtgctcctctgagggaagggtgcacatggggacaggtgtgcttgtctcagggaagggtccatgtgggaacaggtgagctcatctgagggaagagtccacgtggggacaggtgagctcatctgagggaagggtccacatggggacaagtgacctcgtctgagggaagggtccacgtggggacaggtgagctcgtctgaaggaagggtccacttggggaccggtgtgctcctctgagggaagggtccacgtggggacaggtgtgctcctctggagggaagggtccacgtggggacaggtgagttcatctgaaggaagggtccacatggggacagttatgctcctctgagggaagggtccatgtggggacaggtgtgcttgtctcagggaaaggtccacgtggggacaggtgtgctcaccttggggaagaggacagatgagctcatctcagggaaggggccatgtggggacaggaccaagggttgggacttcagcacaagaatttaggaggaacacagtcttccctagcagcctccttcagggatgtcaaatattttccttctgttccctgtgaaagccttaaaggggtagggaaagggcgttcaacctgcacactcgtagaggggaaaccagcttcattagtaatcgttcatctgtggtaaaaaggcaggatttgaagcgatggaagatgggagtacggggcgttggaagacaaagtgccacacagcgcagccttcgaaacacaccacggtcacgttaagtttaaatggagtgaccacattcgccaggaaagggaaatatttacacttttgaagaaacagtaatttgtgtttctgattatgatctggccttggattttccctcccctcataagcaatgacagaattggcagaaatatgtgaaacgttagttctcagacatgagacacccacagagggccccctgtgcccttccctgagagctgatcagctcctgcatctgaagaaatgaccaaagaccaggagagaaccacacagaagcatcggagggacagcacctggggctctgatggggtcaggaatagcatctgttcccaatagatggactaagtaaaaagtatcataattcacaagagttttacatagcacagaagaaaaagttaccctatatcaactgttgatcttgtgaatccaggaactctggattcaaggtggtcgggcacatcttgatttacgcatttcagggacacatgagacatcagtcaatataagtaagaaggacattagttccatccagaaaggctgagacaactcaaagcaagtcctccccacttagggcttccaggtcacaggtaggtgagagacagatggttgcattcttttgagtttctgataagtgtttgcaaaggaggccatgaggatatgcacctgtctctgtgagcagagggacaactttaaatagactgggaggcagatttgtcctgagtggtttccagcttgacggggcccaagatattttcctttcacaatctggtaacttcaaacaaaacttcaaagccacaacaaaacaacacaacaacaaaaagaataagacatgggtacttattaagagtagaaaaacattcagtccccaaggaaaatattggcagtgtctacctccacatgacaaaggagtaagcagtgtgagccacagaaaggagcactattaacccacagagcaaccgagaataacacgggtgatgcgagggcattggacgcacatcattgcattttgtagattcagaaagaaacggaaaagattgacggtggtaaaagagacagccctgcttccctctcccttttccctccccgatgaggcctcacagccatgaccctcagcctcatcccgcagtgcagcagctgccgtcctgtccaggcccaccccctgccccgccctgggactgttacctcattccctcccggagtccaggtgccccccggggtgtggtgcgggagcctggggaggccctttgttctctgtcagggtctccctgggagggacgcagccaccgcagctggttggggcctggcttcgcccaggacagtcctttcctttcccattgtctttggatgactatcgctgggctgggacatgaggcgggcagaggcgcgggtcacccttaggacccccctcttgctgctggggctctgggcgctcctggctccggtccggtgttctcaaggccgtcccttgtggcactatgcctcctccgaggtggtgattcccaggaaggagacacaccatagcaaaggccttcagtttcccggctggctgtcctacagcctgtgttttggggtcaaagacacgtcattcacatgcggaggaaacaccttctttggcctagacatctgctggtgacaactcaggatgaccaaggagtcttgcagatgggtgacccctacatccctccagactgctagtacctcggctacctggaggaggtgcctctgtccatggtcaccgtcgacacgtgctatggggacctcagaggcatcatgaggctggacgaccttgcgtacgaaatcaaacccctccaggattcccgcaggtttgaacatgttgtttttcagatagtggccgagcccaacgcaacagggcccacatttagagatgatgacaatgagacagaccccctgttctctgaagcaaatgacagcatgaatcccaggatatctaattcgctgtatagttctcatagaggcaatataaaaggccacgttcaatgttccaattcatattatcgcatatatggcaatattacaacttgttccaaagaggtggtccagatgttcagtctcattgacagcattgctcaaaatattgatctgcggtactatatttatcttttgaccatatataataatcgtgacccagcccctgtgaatgaatatcgaattcagagtgcaatgtttacctattttaaaacaactttttttgatacttttcatgttcattcatccacactacttattaaatacgtgccacatgaatctaactatgaacctgaaaggtataacttctgttcccgtatagccctgttacacattggtactccaggcagacattatttattggtagccgtcataataacccagacacagatgagaagtattggtctggagtatgatgataactactgcacatgtcagagaagggcctcctgcattatgcagcgatttcctgggatgacagatgcgttcagtaactgttcttatggacatgcacaaaattgttttatacattcaggccggtgtgtttttgaaacacttgctcctgtgtataacgaaaccatgacaacggttcgctgtggaaacctcatagtggaggggagggaggaatgtgactgtggctccttcaagcagtgttatgccagttattgctgccaaagtgactgtcacttaacaccggggagcatctgccatataggagagtgctgtacaaactgcagcttctccccaccagggactctctgcagacctatccaaaatatatgtgaccttccagagtactgtcacgggaccaccgtgacatgtcccgcaaacgtttatatgcaagatggaaccccgtgcactgaagaaggctactgctatcgtgggaactgcactgatcgcaatgtgctctgcaaggcgatctttggtgtcagtgctgaggatgctcccgaggtctgctatgacataaatcttgaaagctaccgatttggacattgtattagacaacaaacatatctcagctaccaggcttgtgcaggaatagataagttttgtggaagactgcagtgtaccaatgtgacccatcttccccggctgcaggaacgtgtttcattccatcactcagtgagaggagggtttcagtgttttggactggatgaacaccatgcaacagacacgactgatgttgggcgtgtgatagatggcactccttgtgttcatggaaacttctgtaataacacccagtgcaatgtgactatcacttcactgggctacaactgccaccctcagaagtgcggtcatagaggagtctgcaacaacagaaggaactgccattgccatataggctgggatcctccactgtgcctaagaagaggtgctggtgggagtgtcaacagcgggccacctccaaaaagaacacgttccgtcaaacaaagccagcaatcagtgatgtatctgagagtggtctttggtcgtatttacgccttcataattgcactgctctttgggacagccaaaaatgtgcgaactatcaggaccaccaccgttaaggaagggacagttactaaccctgaataacactaattcagcctcccgatccctgtaaagatacagagaatataacagcaaaatctatgaaacaggatcaggggaagggatggcaaagctcaagtccacatttcttgaagtccacaggaagcacagggtcctgtttcacatcacagggaaacgggaggcattggcttctgtcccaggttcttgtaggtcgctgatgctcactctgaaataaatcttcaaaaacacacattggtgccttccacattttcttagactcctctgggagcccaaacttggccagaacctcttgcctggagagacatgaatgagcatctggctcttgtcctgaggtctctggtcccagaattaacggaagttgccaccagctccttacagggaacattcatgacatttctccagaagagagctccagagcaatgagcttcctcattccccaggtaatctgtccttctctaaacccgaagtcagtttagggtgatccagggctactccctgttccctgtctgttcctcacgggggtgctgtgggctttgcagtgagagggacttgggttcaaatcccccaccaagcaaatccccctacctggggccgagcttcccgtatgtgggaaaatgaatccctgaggtcgattgctgcatgcaatgaaattcaactagaaaaataggtagacgtgaggggcaagctgtctgtcatttagtgtgagctctgtgagtggcagctgccccctttcttcctgcccccacatttccttgaactgaaacaggaagggaagctgagtaagtcgtgatgaggaagagaaaccaggcttgtagcagcacaggctggtccgggtggaaaacagggctaggtgtatcactgagttattgtaaaggaaaatggaagttaaatgtataaataactgaatgagataacattttattttaacttaaaattcacactaatattgacttttaaaatgcagtgtagatatgtcagagagaatttcaaaggcaaagcccaccgacggaagaaatcacccttcccataccatccacagaaaactgttggtattctagggtagtactgagatctagcatttttctgaatacatctgtggttctagatgtcctgcttccatagatattgtttagaattcccacccctttctccaaacacagcttgatatcctttctctgaacctgttagaaatttcctccattcagctgtcataaagatgcgagcaatccattcctgtgcctctgtcagtgtgttctattattttgtggctgaacgctaatggacagttaagtgtgaggtcagtgaatacagtgccctccctctatgtgtccttcgggtgtgaggggttttgctgatagagcagcaggccccatcccaccctttatgcatctccgccccccacctcacgctccagctgacctctcccctgtggcctggggcgttccccagggggaatgacctctcctctctccagggcccacccactcagtgcccgtgcaagaccaccacgcttggcacggccccacctcgtgtcagggcctgtgtcccctgccccaccccctaaacagatgggaaccactgggactctgctcagggcagggggcggaggtatgtgtgaaaggaaggcaaatgtgcactctgttggagaaatattataggtagtttgagcaaaaaatctaatgccatgggaacttttagaatgatacgtattttaacaaagaacatgaccaatagagtttgtattgaagccaggaaaacactatttagagcaacagcaatatcaaaaacacaagccaacagttcaccaagaaaaaccaccattaaccccatggaaatggtcttccaagagcatcggcacttaaatcctggaaatctgcctgcctcagcacctgttgtcctgacctgccctcctgtgtgtcctaatcactcccaaacacggggcctgcactgtgggagattcacactgtgccaggtggagggagcaggacaactgctaacaggttgttggtgtggatgccgaggccacccaagcaggtgtaaactcccacctgtggggcagggaagagtgcacgggagacatgtcccgggcatagggtgagggagagctgtgggggctctgggttctgaagtgggttctgaagagggttctggcctggcagggataagaccaaccagcatgtgaggccaggctggagtctggacctctgaagctgcaagggtcatgggctgcttggccccaggggctgtcctggttctctatggagtactttcaaacattctttcttcttccaatccccctccttctctcccaaagcctgcatctcccaaatcctctttgtcggatcctcggcttcactctgcatccgtcctgagcatcgatcttccaattccatcctcttctcttctgctatgtctaagctgctgtgaagccacctgctgtaatttactgctttatatttaatattgtaccgtacatctgttctgtttccctcatcataaatgcttcatttcatgctcagcatctgagaacacaaggccttgtcagctgtcacctccttccgttctctgtttccttcctcctatccccatattgctcatcatgtccagtctcctgccatcctgaatgcttctgatggaaggtctgagatgtctcatgagcactgtgaagattctttgtaatgtgagcttgttccaggcaggaattctccttcacccagccctggaagccaagtataggcagatggccatgctcaatcaaagactgagctaacttaacagtggctttggttttaaggtttctccaatccccagggcacaggatttcagggaattcaggtgagagtctgggtgttacccttcaggaggctgtaaactccatttcacctagtctacaccacagactatggaaactatatatatatatagttctgtccctctagagaaacctaatatgtatatatacaatatataatacgtattatatattatatataatacgtattatatattatatatattatatatatattagagtttattgaggagtattaaactcacaatcacaaggtcccacagtaggccatctgcaagctgaggagcaaggaagccagtccgagtcccaaagctgaagaatttgaagtctgatgttcgacggcaggaagcatccagcacaggagaaagatgtaggctgggaggctaagccagtctagtcttttcacgtttttctgcctgctttatatcctggccacactggcagctgattagatggtgcccacctagattaagggtgggtctgcctttcccagtttactggctcaaatgttaatctcctttggcaacaccctcacagacacacccaggatcaatactttgcatgcttcaatccaatcaagttgacactcagtatcaaccatcacaagtccaccccttgtcaacttgaacccatacaaatctcctgagatcatacataatcttcaaataaagacaataataaggtcataattacacctaatgtaatacaactatcttttgtacaaccagaaatgcaccaatccccaacccaaatgctattatgtaaagttaagaacacttaaatgctgatatgaagtcaataaattttatgtcacatgataaaggaaaaaagaaatgaaggaattttcttagtacaagtgtgtacatgcacaaacatgtttttaacaaaagaagaaggaaatactgatgacaattacagtcctcatttctgcaactgatcacgtggttgtagctggtattgatgactaccttcttctactacccattctgtattccctttgccttcagcaagcatcacagcaggtagagttttttctcctagtggagtgatgcaaaccttcattcctgaagggtctgggccatttgtagtcctgcctggattgggctgttgtagtttcccgttgaccttaatgacagggcatggtaatgttaagagacgccctaatggatctcctgtattccatacatattcttccttacctccattgtggagtaatagactgattgcatcttgatagtccaggtcaatcagcccagccaacactgtaactcccctcttagcctgtggacttaaaggtaggaggggcccaaagtggccaggtggaaatctttacttccagtttaatggaattgttgttgtttctcctgatggcagcattattcccactggaactaagacctctaggccaacagaatgtaatgtcatgggaccaggaagcaaaaattttgctagtggatcactaggggtgatggtgaatggtgccatttccacttccaccccttgattcctggatccatgaattatggctatgggagaaagagtaccatatattggatgctgatttggagcatacatggccttttggagagctttgccccagccctgcaaagtattggagcctagttgacattgtaattgtgactttgaaaggccattccattcttctatcaatccagctgcttcaggatgatggggaaaatggtaagacaagtgaatcccatgagcatgagcccactgccacacttctttagccgtaaagggagtgccttggtcagaggcaatgctatgtggaatactgtgacagtggataaggcattccatgactccacagatggtagtcttggcagaagcattgcatgcatatctgcagtaagtgtctatttcagtgaggacaaacctctgccctttccaggatggaagaggtccaatataatccaacctgccatcaggtagctcactgatcaccctgaggaatggtgtcatttgggtagagacccagagccaaaccagatcacgccacccaacccctcccaaatctcatgtcctctttgcatttcaaaaccaatcatgccttcccaacagtcccccaacatcttaactcatttcagtattaactcaaaagtccaaatccaaagtcacattggagacaaggcaagtccctttcatctatgaacctgtaaaatgaaaaacaagtcagttacttccaagacaaaatgggggtacaggcattagatacatgctcccatttcagttgggagaaatgagccagaataaaggggcttcaggtcacatgcaagcccaaactccagtggggcagtcattaaatcttaaagcttcaaaataatctcctttgactccattcctcacattcagggcatgcttatgcaaagtgggggctcctacaaccttgggaagctctcaccctgtggctttgcagctctgaccccatggctgctctcatgggctttgcagagttcagccctcctggctgctctcattgagtgcatgcagcttttccaggtgcacagtgcaagccgttaatggatctaccattctggggtctgaaagatggtggccctcttctcacagccccattagtcactgtctccagtggggactctgtgtgggggctccaaccccacatttcccttctgcactgccctagcagaggctctccatgaaggctttgcccctggcgcagacttctggctggacatccagtcatttctataaatcctctgagatctgggtggaggatcacaaagctgaactcttctcttccgcacatccctaggcccaacatcatgtagaagccaccaatgattggggctttctgaagcaatggcctgagctgtacattggacttttttagccacagctagacctggagcagctgggacacagggcaccaagtcccaaggctccaaagagaagctgggccctggacccagcccatgaaaacatttttccctgataggcctccaggcctgtgattggaagggctgctgcaaagatctccgacatgccctggaaacattttccccattgtcttgattattaatattcatctcttcattacttatgcaaatttctgcagccaacttgaatttctccctagcaaatgtgtttttctttactaccacatggccaggctgcaaattttccaaacttttatgctctgtttcccttttaaaaataagttcctatttcagatcatctctctcaagggcaaagttccacagatttctagggcagggacaaaattccatcaagcttggttttatacattttagagaggcatgagacatcaatcaaatacatttaagagacacattggtttggtccagaaaggtggaacaactcaaagctagggcttccaggctataggtgaatttaaatattttctggttgacaattggttgagtttgtctaaagacctgggatagatagaaaggtaatgttcaggttaagataaagattgtagagtccaaagttcttttgaagtcttatagtggctgcccttagagataataggtgacaaatgtttcctattcaaatcttagttgaactctttaggattgggaggttctagaagaaaaagatctagctatgttaatagagattctttacagatgcaaattttcccccacaaagaacagctttgcagggccctttctttctttctttctttctttctttctttctttctttctttctttctttctttctttcttttttagatggagttttgctcttgttgcccaggctagagtataatggcacgatcttgtctcaccacaacctccacctcctgggttcaagtaattctcctgcctcagtctcccgagtagctatgattacaggcatgcaccaccacacccggctaattctgtatttttagtagacacagggtttctccatgttggtgaggctggtctcgaactcccaacctcaggtgatccgcccacctcagcctcccaaagtgctgggattacaggcatgagccaccatgcccggcctgcagggccatctcagagtatggcaaagaaacatgttttggggtaaaatattttgattttcttatttgtctcataatgttatgccagagtcagtttggaaagtaaatcatgatatataggtttaaataaaacccatctgatgagaatttatgatttgtagagcatgcctccccagactctttagataggaatttgggcaagatgaaaaaaaaatcagagtttagtcctcactacctaagaccagctcagcttggacttcactgttcatgtcactatcagcattttagtcaaaaccactcaataagtctctaggaagttccaaactttcccacatcttcccttctcctttcaagttctccaaactgttccaaccgctgccaggaggtacccagttccaaagttgcttccagattttgagttatctttatagcagttccccactcctggtaccaatttactatattagtctgtttccacagtgctataaagaactgcccgaaagtggttaatttgtaaagaaaagaggtttaattgactcacagtgctgtgtggttagggtcggaggctcaggaaacttgcaatcatggtggaagtggaagcaggcatgtgacacatggcagcaggtgagagagagaaagagagagagagggaatgaaggaggaaccaccatacatggataaaaccatcagatctcatgagaactcactcactatcaggagaacatgaggacagcatgggggaaaccacccctatgacccagtcacctcccaccaggtccaccccttgacacataaggattactatttgagatgagatttgtttaatgacacagagccaaaccacatcagcatgtgacaaaggtctaatatcaagaatctatgagggggcagttccaaaatggctgaataggaacagctccagtctacagctcccagcatgagctacacagaagacaggtgatttctgcatttccaactgaggtactgggttcatctcacgggggcttgttggacagtgggggcaggacagtgggtgcagcccaccaagagtgagctgaagcagggcgaggcattgcctaacccaggaagtgcaaggggtcagggaattcccgttcctagccaagggaagcggtgatggacggcacctggaaaatccggtcactcccaccctaatactgcacttttccaacggtcttagcaaatggcacaccaggagattatatcctatgcctggcttggaggttcccatgcccacggaacctcgcttattgctagcacagcagtctgagatcaaactgcaaggtggcagtgaggctgggggaggggtgcccacaattgctgaggcttgagtaagtaaacaaagtggctgggaagctcaaactgggtggagtccactgcagctcaaggagacctgtctgcctctgtagactccacctctgggggcagggcatagctgaacaaaaggcagcagaaacctctgcagacttaaatgtccctgtctgacagctttgaagagagtagtgtttctcccacatggactttgagatctgagaatggacagactgcctcctcaagtgggtccctgacccccgagtagcctaactgggaggcaccctccagtaggggcagactgacaccttacacggctgggtgcccctctgagatgaagcttccagaggaattatcaggcagcaacatttgctgttcagcaatattcgctgttctgcagcctctgctgctgatacccaggaaaatagggtctgcagtagacctccagcaaactccaacagacctgcagctgagggtcctgactgtcagaaggaaaactaacaaacagaaaggacatccacatgaaaaccccatctgtacatcaccattatcaaagacaaaaggtagataaaaccacaaagatggggaaaaaacagggcagaaaagctgaaaattctaaaaatcaaagtgcctctccccctccaaaggaatgcagctcctcgccagcaatggaacaaagctggatggagaatgactttgatgagttgagagaaggtttcagatgatcaaacttctccgagctaaaggaggaagttggaacccattgcaaagaagctaaaaaccttgaaaaaagatcagatgagtagctaactagaataatcagtgtagagaagtccttaaatgacctgatggagctgaaaaccatggtatgagaactacgtgatgaatgcacaagcttcagtagccgattcgatcaactggaagaaagggtatcagtgattgaagatcaaatgaaagaaatgaagggagaagagaagtttagaggaaaaaaaagtaaaaagaaagaaacaaaccctccaagaaatatcagactatgtgaaaagaccaaatctatgtctgattggtgcacctgaaagtgacagggagaatggaaccaagttggaaaacaccctgcagtatattatccagcagaacttccccaacctagcaagacaggccaacattcaaattcaggaaatacagagaaccccacaaagatactcctcgagaagagcaactccaagacacataattgttagattcaccaaagttgaaatgaaggaaaaaatattaagggcagccagagagaaaggtcgggttaccctcaaagggaagcccatcagactaacagctgatctctcagcagaaactctacaagccagaagagagtgggggccaatattcaacattcttaaagaaaagaaatttcaacccagaatttcatatccatccaaactaagcttcataagtgaaggagaaataaaatcctttacagacaaacaaatgctgatagattttgtcatcaccaggcctgccctacaggagctcctgaaggaagcactaaacatggaaaggaacaactggtaccagccactgcaaaaacatgccaaatcataaagaccaccaaagcgaggaagaaactgcatcaactaacgagccaaataaccagctaacatcataatgacaggatcaaattcacacataacaatattaacctttaatgtaaatgggctaaatgctccaattaaaagacacagactggcaaattggataaagagtcaagacccatcagtgtgctgtattcaggagacccatctcacatgcagagacacacataggctcaaaataaaggcatggaggaagatctaccaagcaactggaaaacaaaaaaaggcaggagttgcaatcctagtctctgataaaagagactttaaaccaacaaagatcaaaagagacgaagaagaccattacataatggtaaagggatcaattcaacaagaagagctaactatcctaaatatatatgcatccaatacaggagcacccagattcataaagcaagtccttggagacctacaaagagacttagattcccacacaataataatgggagactttaacaccccactgtcaacattagacagatcaacgagacagaaagttaataaggatatccagcaactgaactcggctctgcaccaagcagacctaatagacatctacagaactctccaccccaaatcaacagaatatacattcttttcagcaccacaccacacctattccaaaattgaccacatagatggaagtaaagcactcctcagcaaatgtaaaagaacagaaattataacaaactgtctctcagagcacagtgcaatcaaactagaactcaggattaagaaactcactcaaaaccactcaactacatggaaactgaacaacctgctcctgaatgactactgggtacataatgaaacgaaggcagaaataaagatgttctttgaaaccagtgagaacaaagacacaacataccagaatctctgggacacattcaaagcagagtgtagagggaaatttatagcactaaatgcccacaagagaaagcaggaaaaatctaaaattgacaccctaacatcacaattaaaagagctagagaagcaagtgcaaacacattcaaaagccagcagaaggcaagacataactaagatcagagcagaactgaaggaaacagagacacaaaaaaacccttcaaaaaatcaatgaatccaggagctggttttttgaaaagatcaacaaaattgatagaccactagcaagactaataaagaagaaaagagagaagaatcaaatagatgcaataaaaaatgataaaggggatatcaccaccgatcccacagaaatacaaactaccatcagagaatactataaacacctctacggaaataaactagaaaatctagaagaaatggataaatttctcgacacatacaccatcccaagactaaaccaggaagaagttgaatctctgaatagaccaataacaggctctgaaattgaggcaataattaatagcttaacaaccaaaaaaagtccaggaacagatggattcacagccgaattctaccagagctacaaggaggagctggtaccattccttctgaaactattccaatctatagaaaaagagggaatcctccctaactcattttatgaggccagcatcatcctaataccaaagcctggcagagacacaacaaaaaaaaagagaattttaggccaataaccctgatgaacatcaatgcaaaaatcctcaataaaatactggcaaaccgaatccagcagcacatcaaaaagcttatccaccatgatcaagtgggcttcatccctgggatgcaagtctggttcaacatacgcaaatcaataaacgtaatccagcatataaacagaaccaacgacaaaaaacacatgattatctcaatagatgcagaaaaggcctttgacaaaattcaacaacacttcatgctaaaaactctcaataaattagatattgatgggacgtatctcaaaataataagagctatctatgacaaacccacagccaatatcatactgaatgggcaaaaactacaagcattccctttgaaagctggcacaagacagagacaccctctctcaccactcctattcaacatagtgttggaagttctggccagggcaatcaggcaggagaaggaaataaagggtattcaattaggaaaagaggaagtcaaattgtcgctgtttgcagatgacatgattgtatatctagaaaaccccatcgtctcagcccaaaatctccttaagctgataagcaacttcagcaaagtctcaagatacaaaatcaatgtgcaaaaatcacacgcatttctataacccaataacagacaaacagagagccaaatcatgagtgaactcccattcacaattgcttcaaagagaataaaataccttggaatccaacttacaagggacgtgaaggacctcttcaaggagaactacaaaccactgctcaatgaaataaaagaggatacaaacaaatggaaaaacattccatgctcatgggtaggaaggatcaatatcctgaaaatggccatactgcccaaggtaatttatagattcaatgacatccccatcaagctaccaatgactttcttcacagaattgggaaaaactgctttaaagttcatatggaaccaaaaaagagcctgcaatgtcaagtcaatcctaagccaaaagaacaaagctggaggcatcacgctacctgacttcaaactatactacgaggttacagtaaccaaaacagcatggtactggtaccaaaacagagatacagaccaatggaacagaacagagccctcagaaataatgccgcatatctacaactatctgatttttggcaaacctgacaaaaacaagaaatgggaaaacgattccctatttaataaatggtgctgggaaaactggctagccatatgtagaaagctgaaactggatcccttccttacacattatacaaaaattaattcaagaggattaaagacttaaatgttagacctaaaaccataaaaaccctagaagaaaacctaggcaataccattcaggacataggcatgggcaaggacttcatgtctaaaacaccaaaagcaatgacaacaaaagccaaaattgacaaatgggatctaattaaactaaagagcttctgcacagcaaaagaaactaccatcagagtaaacaggcaacctacagaatgggagaaaatttttgcaatctacttatctgacaaagggctaatatccagaatctacaatgaactcaaacaaatttacaagaaaaacaaacaaccccatcaaaaagtgggcaaaggatatgaatagacacttctcaaaagaagacatttatggagccaaaagacacatgaaaaaatgctcatcatcactagccatcagagaaatgcaaatcaaaaccacaatgagataccatctcacaccagttagaacggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaaacatgctgctataaagacacatgcacacgtatgtttattgcggcactattcacaatagcaaagacttggaaccaacccatatgtccaacaatgatagactggattaagaaaatgtggcacatatacaccatggaatactctgcagccataaaaaaggatgagttcatgtcctttgtagggacatggatgaagctggaaaccatcattctcagcaaactatcacaaggacaaaaagacaaacactgcatgttctcattcataggtgggaattgaacaatgagaacacttggacacaggaaggggaacatcacacaccagggcctgttgtggggtggggggagtggggagggatagcattaggagatatacctaatgttaattgatgagtttatgggtgcagcacaccaacatggcacatatatacatatgtaacaaacctgcacgttgtgcacatgtaccctaaaacttaaagtataataaaaaaatttttaaaaaaagaaacacctgcttttttctgttttccatttgcttagtagatttttctccatccttttactttgagcctggggatgtcattgcatgtgagatgggtctcttgaagacagcatacatttgggtcttgcttctttctccaacttggcaattctctgccctttaattggggcatttagcccatttacattcaaggttaatattgatatgtgcatatttcatcctgttatcatgttgttagctgctcaatatgcagatttgattgtatagttgatttatagtggcaatcgttatgtacttaagtgtgtttttgtggtggccagtaacgttcttccattatcatatttagcaatcccttaagggcctcttgtaaggcaatctagtggtgatgaatacccttagcatttgcttgtctgaaaaggatcttatttctccttcacttgtgaagcttcatttggctagatatgaaattcttgcttggaatttcttttctttaagaatgctgaatataggcccccaatctcttctggattgtacagtttctgctgaaacctccattgttagcctcattgggttccctttgtatgtgacctgaaccttctttctagctgcctctaatattttttttcctttcaacctttaagagtctgatgtctgatggctatatgtcttagggatggttgtcatgtataatatcatgcagaggttatttgcatttcttgaatttgaatgttggcctctctggtgaggttggagaaattttcatggaggatagcctgaaatgtttttcaagtttctttttttctctttctcttcttaagggataccaatgtgtcatagatctggtctttttacataattgcacatttctctgaggttttatgccttcttttttattctttgttctttatttttgtctgactgagttaattcagagaatcagtttttaagctctgtgattctttcctcagcttggtctattctgctgttaatacttgtaattgtattctgaaattcttgaagtgagttttttagctctatcaaatcagtttggttctttcttaaaatggccatttcatctttcagcttctgtatcattttactttatttcttagctcccttggattgggtttcaacattctcctgaatctcagtgatcttctttcctgtgcatattctgaattctatgtctgtcatttcagccatttcagtcaggttaagaaccattgctgggaaaccagtgtgattatttggaggtaagaagacactctggattttagagttgcagagtttcttgcattaattctttctcatctttgtgggctgtttctttaatctttgaagtggctgtcctttggatgtttttgtcttttttgttgttttttggtgtgtgtttttgtttgtttgttcatttgtttgttttttgctcttatcttctttgatactcttgcaggtttgattgtggtataaagtggattcagttagctgtgtttcttgaaaatcttagagggtccaggctcacctcagcactcttgtggtgtgttctctgctctgggactgggcccctggctttattctctggccccttgagtttagaaacttgctgcattggaggggctgaggtgttcccagtccattggccacaacactatagtagggggtgccggccaaagcacttcattagagtggtggcagtgggatccattcttactcatgggtgccagcagttgtggagtcatggcagggtgcacatgcatctgctggggtgggggtactggcaggagcagagtggcagcatccctacataggttcctgctggcagtcacagcgcagtgaggtgcccgtgtgttggcagggacagggtggtggggcacacatgcacatgcttgctggtggtagagggagttgtgatctgctgtgcactcatgccagcaaagcagttgggaggtactatgggtggactggtgcacatcagcagaggctggcctgctggaggtctccaatggttaggcatggtctgctggcaaaggagctatgatgagggcccccaggaaacaccctggttgggcttccaaggctgtactgcaagcaggcacagccagcctggggccccaggagaggccagaaggcaaggaaattctcatttcagatgggccctgtcccatggacaagaccaccctgctttattcaggtcccatagtcactctaaggttaaaatctcctagaggaggttggtgagccttgggggatgggtgtcccctggctgtgctccactacagccattctcatgtcaaacactctgggctttacacagactggagtcctgcccctggcatctctctaagcagctgtcccttccagcacaagtgtccatgggggtcatggggtctcctgctgctaggattctggaggcccatggcaacagcaggccactcctcacctgttcaactcaacctttccccaggagttgctgggagccaggaatgagtcctggtgcttggcatccccatgcagggttcccatcttcctccaccttcagctcagcatctgtgtcctcccccgtctactctcaatccactctcaatgcctccccttcaaagatctgcttggaaagcacccgtcttcctgatgtctcactccctccatggcagatattcctcctggctgcatctagtcagccatcttgactcgcctccaaagtctttttaattaccacttcggttaaattagtaactatcattttacaatggcctgtgattctgttttgatcaaatattttgagccttttagcatctataacaaatgttctcaaaaatcaaaatcctaaatcaagtctctgccttagtcttatttctggggcttattaaggctataaaaattaatcaccataaggttgtacaagctttttacagcttccagtcaggctatgaactccagtatcaccacctccagcctgataattacatatattggaagaaaatcagttaaaggactccctctagacccttgaaagggtgtgagagacaacatggtttcgcctgccttcatgtgtcccagtccatccctgtggctgcctctgtccacctcagcttgcccactgtctttccttcccaactgtctgccctgctgacttctggcctcagtgacagatgcaaagacaaggcgacagccccacatagaccgtttaaccagtcccacatttgcataagctaaatggtcatgtcacagtctgttgcccaggctggtctcaaactcctgggctcaagtgatccacccaccttgacccccaaggtgctgggattacaggcttgagccacagtgcccagccaagaacccgtttttgagtgggcaccttggcacacacctgtaaacgcaacactttgggaggccaaggtgggagtgtggcttgaggccaggaggttgaggttgcagtgagctatgatggcaccacctcactccagcgtgggtggcagagtgagatcctttagaaaaaaaaaaaaaaaaaacttgttttctctgcagccgggctccgtgaccaaacacaaacacaaacttcccctccagagggtccaggaggggctgggctgcaggaggtgcttagggcctcttagggaatggtaagtgaccacccaacgcaggcactcagccccaggggcatatgcagagagagggtccaggaggagctgggctgcaggaggtgcttagggcctcttagggaatggtaagtgaccacccaacgcaggcactcagccccaggggcatatgcagagagagggtccaggaggagctgggctgcaggaggtgattagggcctcttagggaatggtaagtgaccatccaacgcaggcactcagccccaggggcatatgcagagagaggctgggaggacactttcagtgactggggttacaaaccccaaccataagacattgctggctctgtgagccgccacctccagaaatctcccacttagttcttagcacttatccactcttcccttttcctactctcaattcctggaggatgccctcctttctcaggctcagaccaacctaccagctccactctagacctgaacacatgactcctccctctgtctccacctggaaatctcatcagtgcctcacatttacactcctgaaaatcaggtcctgcctacccaccctcttgctccacctgattcctgccctgtttcagccagagaccttgcagtctcctttaactctcaaacccacccatgtcgtgtgagcatactgactgtgttctatgcaagaaagagcagtttcttggtggtcctgcggttttattagtccagaggcaaagcgttggcagagctggtttcttctgaaccctgggagggagattctgttttcatgccttttccagattctagaacccatattccttgctctgtgtccccttcttccatcttcaaaggccatcctctcatctctgtgtccatcatcacatcacccttcccctgactctggttctcctgcttccacttataagcacccttgtgattacatcatacccacccagacaatgcagggccatattctcccctctcgagattaatttaatcacatctacaaagttcctcgtgccatatgaggtcactaaaccacatgttctgggggtttgaatgtaaacatttgggggatgcattattcagccacccacaagcactgctccccactggccacacactatgcacagccgagatcatgcaagtgaggcacgttcatcaacagcagcttcagcaggaaactatatgctccactttcctgccatttgtatctggatttttttttcgctatcattgtagaaagagtggtattgtaaaattaaagatggattattttctttctagaacactttggcaatctatccaacattatttatccccttctgagtgtcaagtgtgaggtcattctttcattgagagctcaatgcctacaattatgataatgcatattgggtactttcacacatcagaaagttcttctttcttaaaatctgttcttgaattattcattcttctctagctttttgttgatctattttataattttagaaaaatcagaaagtaacttgaagtatctgtcatctctacaggtttacctccctctttgtggccttcagaatgtcatgacacgcttttcccttgctcatcacatggtttctatgtatgagacctcatcacaggagctgtggtcccccgggagcaggcatctgtggatggtgccttgctcctggctgctgggacctgtgtgctgccagtggcactccacgacagtgatttcccagctcagttttgcagctccagatggtgggtgagacactaggaccactttgtgaacagcgagggcttggggtttgcttttctaccatgtccagggctgctgttcatgagggaatgtttctaacctgacatcatggctgaagccaacttagaacctctctagccgtatggggagtaggtgagtgatacagatgttaattagctcagtggagccactcccctatgtagacatgttacaaaacattatgctgtacagaataaatataggtcatttttatgtgtcaatcaaaagagaaactaattatttaaaaaaaaaaaaaaaacctctctactcaagccgaaacctcagctccagtcccacaagtcacacaaggctgctcccgtcctgtgtatgttaaacctacctcagaaatgcaagggggcattcaggtttcattctcaattcaaatgccctttttaattttgtctattcctagcacctggcaacttccagctctttttttcggggctcattcattatttaaagcacgtataatttttcacccacattctaacacatgtagtactgtagagaatccttccctaggaggatctacagcattagaaaagaattaagaactccaatatttacaagaaggaaaaagcaaaaagagatcaaaaaatgggcaacttctagaaatagaaaaccctcatgagtatgatgataaatcgctggcacacatgtgaatagttacttgatgcttatagtgatgtctgggaaaataacatgaaatacttataatctgtttctcacacatgtaattcaaaagaatagagagaagatgatttgaaatattcttaagtttgtaggaaaaaagctacttccatatgcataattgcatgtattttgatactgccattattaagaactatctaagagggtccattaaaaataaaatttcttggctgggcacagtggctcatgcctgtatcccagcactttggaaggccgaggcaggtggctcacctgaggtcagaagttcaaaaccagcctggccaacatggtgaaacgctgtatctaccaaaaatacaaaaattagctgggcatggtggcatgcacctgtagtctgagctacttggggggctgaggcaggataatcgtttgaacccaagaggtgtaggttgcagtgagctaagatcataccaccgcactccagcctgacagacaaagcaagactctgtctcaaaaatattaaaataaaatttctcattcctattacagagtaatttaattcattaatgccctgccctgttacaaaactcatttgtaaaatactaattgtaattgtgaaaaaatggcaattgatactaattttaaattctaaaaacagggcacccatattaaagattattctgcagtaagagaattagctataacattttgtaataaggtggagaaaacattctccaacttacaatggttggtgagaagaaagtttccagcacggtagatggaccctaagagcccttgttgaaataataagacaaaaagatatacagagagatgagccagatgaagggagacagagagagagagagagagagagagagaggcacagaaatgagagatacaaagtgaaagagggcaacctgtggggtcatcagatatttgttttctgttttgtttattctaacataaaggcagtggtgggtcatcgatgtatttagagtttgcacaatcactgtggaacacagacagacacaggggaagaggagaaacacagggcggtggcttgcccttggactgttcttagttcctcaaaacgtaacagctttgcccaacctaagggaactttcagcagctgctcttctgccataggcctctttcctgccttgttttcatgtggctgactgtttctgttcctgcaggtcttagctcatcagacaggcatttattacctctgtgtcaacagtgggagcttccattactctctagcatgacactccccttcctcttttaggaaatttaacatggaagtgagtttgccatcggccttctccccacagtgttaacagtggtgaggaagccagcctgttccaccttgcccctcccatgattccaacactgagttcagacttgtcacatggaacttatctttgcatgtttgtggcacagacagatggacccaaccatggattagtggatggatggatggatggatggatggatggatggatggatggatggatagatggatggatggatggctgagtaggtgtgtggatggaagagtgaaaagatagatggatgcatgtatgggtggatgggtaggttgatggatgcatggatgggtggatggatgggtgagtggatgaatgggtgggtaggtgggtggctacatgcatggatgagtacttggatagataagtgagtggatggatggatggatggatgaatgggtatgtgaagggatggatgtattagagtgggtagttaggcaggcatgagctgatagtcaagtgattgttaaactgcctctctaaaataataattggtctcggctggacgcggtggctcatgtctgtaatcccaacactttgggaggctgaggtgggcggatcacaaggtcaagagattgagaccatcctgaccaacatggtgaaaccctgtctttactaaaaatacaaaaattagctgggcgtggtggcgtgcatctatagttccagctactcgggaggctgaggcaggagaattgcttgaacctgggaggaagaggctgcagtgagctgagattgtgccactgcactccagcctggtgacagagcaaagctctgtctcaaataataataataataataaataataattgatctcagccagcgccaagaaaaggcagtctcccaatagatagaaaacacccgaaactggtcatcagcagcttcctgataagatctcaggcattgggtgagtgggctcaagcatatgcactaagaggcaaagtggcagagtttaactggcacataatcttcctctaggaacactctaatagtaagagaaggacacctcaaatgagcatgtgcacatttcattaaacccactgtgtatgcagcccctcccaagtgctggcaggccactgtacatgtgggcagcccactccaagggaagaatcaagggagaagaaatacaaatcccagaaccatgtcaatgtataaaaccccaagtcaagggccggacagagcacttagatctctcaagtcgcccacttagccctcttccaagtgtactttacttcctttagttcccactttaaaactttaataaacatttactcctgctctaaaacttgcttgggtctctcactcttctgtatgccccttggccaaattctttcctccaaggaggcgagaatcaagttgctgcagacctgtatggattcgctcctgctaacagatagctggatgggtggacagatgcatgaattagtggatggacgtttggatgtgtgggtgggtgggtggattgtgggatggctggatgaatgcatggctggatgggtggacagatgcatgaattagtggatggatgtttggatgtgtgagtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctggatgggtggacagatgcatgaattcgtggatggacgtttggatgtgtgggtgggtgggtggattgtgggatggctggatgaatgcatggctgggtgggtggatggatgcatggataagtggtggacggatggacgggtgagtggatgggtggatgtgtgtgtggatgggtggataggaaagccctctaattgattacagggctcagtgtgtgcttcaacatcatgatggcatcatcacattggtccctgtatgaagcagtgggggaggagagtgtaccaggggagcaggaatgacttttctccagaatcgacctctcccaccctgcagcctgggctgtgcaggccacattggagaaggtgcggtcgactactcctaaatgttgttgtgtccaatggcttgttgacgttgatgtaggaatgagcctacatctccaccatagatggaactgtttgggtccccaaagcagaaagcctcttctgttgcaggtgctgaagtttccatcttcttctgcttatacggaagctcacgcatcccttggatggcaggcgtcaggttcctgtgcgcactgagttccccccttacatgctttggacagaagtgtgagacacacaagattgctgcaggaagtccacctgtggggatgctgcgacttctccagcaagaacacgagtctgctcattgaccatcaccacacataacaaattaagtgtcccttttttgataacacgtcattgtttcacagagtattcttttaaagtgtataagttgactgcagttattattttttacttctgttactaatttactcataattaggcacaatttacacttaagaaatttcttaatagttttttcctccttaaggtgaactacagtcagataacatacttatcaattgtctctagctcttgtcagaaaaacatatagatgtgtgtgtgcgtgtgtcttggcctttccaatgatgaattaagatgtgcattgagaaggcattcactttatttgacgttaaggaagtaccaagaagacgctctccacagaccctgggaaagccagcagctgcaccccgaggctgtgccaggcagggaacaaggaggcagcaccacctgctgggcagggaaaatgtcctcccagtccctgccgcttctctgcagaggcacaaagagctgccccttctcctgggccttctcctgggctgatgagattgctccccgatatgccaaatcagggttgtgcatctgaggctctgtctagactctcagctccttcctactcctgcaaagtgaagaaaacaatgccaaggggtcctggaggcgtctctacccctggagagttttgactctcttcaatagtctccactaccctgccctcactccatgtcctccgtttctccctaaagcggtgcccagtctgattgcactgtggcagggataacgaggggccaggacatcaggggagagaagtttctacctgagtcacagcagcggctgccctgcagactcctgaagacacaagacacatttccatcccagagacccagcgaaatgcaacctcaggctagagacagccagttattttttcttgttctgtcctggagaggccactgagaaagtcgagccccttgttgaggaaaacatgagatctctgtgtgtcgtcctctgcctgatggctgtacctccatgtgagtgtctcagagatttcagaacgggggctgtgggctgtggtgtccgcttgtgactcatctctttgcttcttgtccctgagtgtcctgcatcagatgcagctactggagtcatgcccagggctggtgaggtcctcacagacctctgggcctggacccagcagccctctgggaaggcgctggggcacctcagctccaggggcagcacacacttcagcccagcctttctgggccaactctccatctgtagagacacatccaaggcccagttatccctgcagctgagctccgtgatggccaagggcagggccgcacattcccgtgggagacagaatggggacctcagcgtgagcccagacacaaacctccctgcagggaagcacaagaccaccaggcggcgctccagaccacacagcggccccagaagcaggttttagggggcggggcagacgtgtccgcgttgagtcaggtcattggttttactttccctgagcaaacggcctctgccaaggactcactgcacctctcaccttcacagttgttttttttttttttttaatcaccctgtagagttttgctagctaatttagatattgaggagtgcttcatacttccttgggcctctgcttgcagaaacatagcaattgtaaggaggcacgtgggaaagccccggctcggtgacccgggggatgctgctgtggccctggcaagagggcgtcgggccgcagtaacaaaggtgcagacggctctcagcctgcgcccgcggagtacaacacataagggctgtaacctaacgaaaaaagaatcgcagtgcaactgtcctgcatttgagtttgtgatcagttttgccctttgtctttaacaggttctaacataaaattttgaatgttggttcaagccctgtgggtaaaatgcacttacccacattccttaaacaaatagaacactgaggtggaaatgttttgaaaaagtagttttcagacatttggaaacaagcatcacaggatcataacccctgagaaaagaaaaacaaatgaacgaatcctgctattgcctgaaagcagctgccaggacacacggaaaggcttagtgagctgagcggacagagagcagagttcaaggcagcagcagcccgaggggaggagcaccggggagcaggctgctgtgcagccaggatgggccggggtggggcggggggagaacagctggagacttgccgcagggagggggatccctcaggtttggggctgagaactgacttatgcctgacttatgcctgcatgaaaagaaactactcgatatcagggggaaatcaccagaaacctgtggacccaaaactacacagagcctacacaaggaaagcattgtttgtgttctcccagccagggtggaaagaccttgagatatgtaaagcttcaagcaatcttccgaagtaatctcgtgagtagtggtgccacattaattcaggactaaaggctgctctgaactgaacctaagaaatgcttcaagtgtagcctggagcccgggtgcagtggctcacacctgtaatcccagcactgtgggaggccgaggcaggcggatcacttgaggtcaggactttgagaccagcctggccaacatggcaaaacctgtctctactaaaaacacaaaaattagctgggcgtggtggcagatgcctgtaatcacctcccacctggacccttccttgatacatcagaattacaactagagatgagattggggtggggacacagagccaaaccgtatcacataggaacctaaaaggataataaagtaggaaaacttcccacatcagtaaccctttatccgatagtaatcccaatctgcaaagtaaaactgtgtgattttactaagataacggaatcttctctacagaaggactttccagtgcaaaagctccccaccctcaccatgaaatgcacgtgaccatttccaatttgtgtaaagtcctcagttagtactgagacttcggaaggttagaaatccctttgctcatgctgcatggtccggatgagatgtaagaatcattagctaatagacatgcaacagcttttgtgtgaaagatgttatgagacatttaaggtatttgcttgtgattactaagcattcattgtatcattggagcacatgtgcttttataccctggagaaattccagtaattgaattgctgggttgaatgggattttgatttggattaaatttaaactatagattttatttagggaaaactggcatcttaattatgttattggggggcccttgctcccagagctcccaagatggtggcaggccgcttccaaaatgaccgcaggccacttccaagatggtggcaagcctcatgttctctgacctggggttcttggcctcacggattccaaggaatggaagcttgggccatgcagtgagtgttatagctctattagaagccgtgggtcacggaagagaaccgtggaacccagtgactagtgttcagctcgattaggacgaacccaggcacttagccgtgcaggaacaatggcgagcatttggcccgatcgagagtggcaatgggcgcctcgctggatcaggagcacagcggataccctgatggatccggagggatggaagccagcggtgggtctcccacgggggcaaacagcagtggtggacggtgagcgaaagcgaagctcgagccgtaacaaacatggaccagaagagtgcagttgcaagatttagtagagtgaagacagagctcccatacaaagggaggggacccaaagagggtagctgttaccggctcgaatgcctgggtttatatcccgatcattgtccctcccgctgtgctctcaggtgatagatgattggctatttctttacctcctgcttttgcctaattagcattttagtgagctctctttactatctgattggtcgggtgtgagctgagttgcaagccccgtgtttaaaggtggaagtggtcaccttcccagctgggcttagggattcttagtcggcctaggaaatccagctagtcctgtctctcaattacactgagttttccaatccatgcatccaatatgtggtgtatctcttcatatgttcatagcctctgagcaatgttttacaattttctgtgtaaagaactccacatcgttttatgtttcttctaaggtatatcctgattgctttttatgtcttcacaagttttttcctttcaaaattaattttccaattgtttggtgctaatatgctcaaatgtccttgattttcttagtttgaacagtccgtttttgttttggggatttatttttttttcagattctttaagattttctatgtctataaccatataatctctgaacagagacagttttgctttttcctttcaacttgaggtaggttttctgggtagttcaggacgcgcaggcactgggtgggtggtgttagcagctgcacgatgccttggagaggacactctcgggggactgtggccgctgctcagctgtgaccgttcttatagcaccagcagctgcggccaccattcttatccaatttccaaagccacaccacaggccctctcaagaacgaggcgtggaggctatgccctctcctggacacatcatcattcccaagccccacgatgtgggccccatgggacgcacacctttgtctgtccagacctcagccccacctcctcatcctgcaccagaactcttcagagcccagtgcatgaaatgggctaccaaggaaatgagggtaggttcctgagaggaaactggccctgcatttgggagctaggagtctgctaattcgcctggcagccctgtgcagccctccgtggctacagtccaccccgtgcccatcagtgcctccttcctgtgcaagcctggacctcgccctgggctcaggatgggctgtagaccgagaatgcaggcgggaaagtctttgtctatcggggccatagtcaggttctacagtgagtcagggaaagacctgtggaggtgtggatgaggacaatgggtccaccatcaacaggaggacacgggttcgaccccttgcagaggcacagtcccacatcactgggaggcagccacactcactgcctcgccctctcctcacacagtgcagtttccacgttcacagccccagccagtcaccaggaatgccctgggggcggcctttccccagtgcactccgagccctcccttggctgtgcggtgagctccatgcccaggagatatccacccatagtcctccggaaagcagctgacctgccatgccctggaaccacaaatccccacagatcagccagcctgcagtgggccttggatgtggtgaggagtggtggcacccccgttcccaccccacagatgcaacgcctgtgggtgacgcatgtgagtactgaggagtagagggtagaactgtaggccccgagaaccacagaaactcgggtgttacactctggggccatgtaaggagaaagtgtcactggacagaaacaggcccctcctagacactgtgtgcgccatagtcacctgtcattagctctcactcttgcagattcatgattgaggtggttaaaaaaaaaaaagctcctactcacccatccaaccccatcctggggtgtttccaccacccttggggtttgggatgagctgcccttgcccactgtgctctgtggacctccctttagaagctcacagctccctgcactcggctccatcctgccccaccacacagaagcaaaacccctctcctttccactgcaggcttttcctggaccagaatgctgacctgctgcccttcactcccgaagtggtgggactgcctggggtggtgtgggtgttgagccttcttactctagggacctggcacctggccccaggggcacagggatggtgcatctgcctagggatgcctcctcatgccagggggtgggggttagtaccatcggccctcaggatttgttgcatgaatgagtgaatgggtgaataaatgaaggggatctgatctatgaataagggtatatagactttggttgatgtaggacgccaaatgctggaatttcagagtcatcacacccaggggccctgcctctgagctcctctttgcatccaatctgctgaagaacatggctctagggaaacccagttgtagacctgagggccccggctcttcaatgagccatctccgtcccggggccttatatcagcaagtgacgcacacaggcaaatgccagggtgtggtttcctgtttaaatgtagcctcccccgctgcagaactgcagagcctgctgaattctggctgaccagggcagtcaccagactcgagtgccatttcattacctctttctccgcacccgacatagattctcactcacctgtgccatctccggggacagtgtctctagcaacagtgctgcttggaactggatcaggcagtccccatcgagaggccttgagtggctgggaaggacatactacaggtccaagtggtataatgattatgcagtatctgtgaaaagtcgaataaccatcaacccagacacatccaagaaccagttctccctgcagctgaactctgtgactcccgaggacacggctgtgtattactgtgcaagagacacagtgaggggaagtcagtgtgagcccagacacaaacctccctgcagggatgctcaggaccccagaaggcacccagcactaccagcgcagggcccagaccaggagcaggtgtggagttaagcaaaaatggaacttcttgctgtgtcttaaactgttgttgttttttttttttttttggctcagcaacagagatcatagaaaaccctttttcatatttttgaaatctgttcttagtctaatggagattctctaatatgtgacaatgtttttctcttgctgtttttggaattctttgtctttgacttttgacaacttgacttttgacagtgtgcctcaaagaagttctattttgggttctgtgaacctcctggatctgggaagttttcagctatgatttcattaaacgtgttttctacaccatttccctactcttttggaatacccataatgcaaatatttgttcacttaattgtgtcccataaatgctggggattttcttcattcctttttactctttttttctttttattcatctgcctgaattatttcaaaagatctgtcttcaacttcagaaactcttttgcttggcctagtctaatcttgaaggtctcaattgtacttttaatttcattcattgaattcttcaactctggaatttctgttggttcttttttatgatacttatctctttgttgaattcctcattcaaatgataaattgttttcctgatttcactgaattttctatctgtacactattgtatctccctgagtttcttagagattatccttttgaattatttttctgacattctgtatatttccttatgattggggtctgctactggagaatgactgttgtctttttcaggtgtcgtgtttcctggccttttcatgttttatgtgttcctacgttgatttctacacatctggcggaccagtcatcccttgcaatttaatggagtaggttttgcaggaaaagacttcctagtacagacgggtctcagggtgtcagtgtggcggggcgtgctggctttagttctaggttgacgcagtagcgtagtctccatgtcgtttcttcagctgccgtccacattggtgacgtttgcgagtgtctcagtggcctgggctgagaggtttgtggcagtggaagtgcaacgttgctagaggtggactcaccaggctgtttctgaggtcgaggcacatgcatgcacatggtggattgaccaacttggtgccaggctcactagggttggggacatggggctgtttctcaggcccaggatgcaaacacaagtctctttggctggcctgggggtgtggcttctgagggcaatccacagggctgtttctcaggttcaggacacaagtgcatggccgctcaactggcctgggcatgtgtctcccagggccaccccatgggctctttctcagacccaggacatggccacatggcttcctcagctggcctgggtgtgtgtctgctggggggctgcaggggcacagggttatttctcaggccggggtcatgggcgcacagctgcttgctggcttataggagtgcctgccaggggtggcccatgatgctgtttctcaggcctaatttcaggtgcagagcctttgggcaggtcaacggcatacctgtggaaattggagtggatgccacagggctatttctcaggtgcctgagtgtgggcacatatccactctgccagcctggagttagtatcaggtgctcggtggctcaggggcctctcctgctcaggggagggccctcagcagcttggccaaatcaatggtggattcaccctgggcaggcctggcaggctcttcctccagctggatgtgcagcagcaggggttgggttttttgctgtgcagggccagagtcacggccaatcctcagcctaggctctgcacagccagggttgtggcattcagccacccagatatgggcatcctgaagatggagccccaatgctagaaaggggcagtggctaccagcctcagggcaggatgcactccagaggcggctccggtctcaaggtggcgctgggctgcagcagctaggctcacagtggatgaatgggggcagggagtacacaccttgtgctcctaatctgggatcattcctggcagctcccaaacttggctgagggcttgcaaaacctgtggaattctcctgttgcaagggctgtagatgtttgcagtggcagtgggtgctggcgggaaatctgcttaccttttccctacatgggaagtccctcctgtgtccagaccaatccgatctgggtggggaagacaaggctgcaaaggccaggtgcctccatgctgccctccgatcaccacgggtgcgtttccacacctccactgcactccgtcagtctcccttcaacactccagtcaaaccttagctgtttcttctttgccttattccttcctcatggggagggtgtgggtgaacaccaggcttctctaagttcttcatccatcttgctgatgtcattctccatccaggcatgggtttttaagaagtagtgaatactgaaatttcagcagaggacacctctataaaaattctgcaactggaaaacctccttaaattggctgattgtcattacaattggaggaaaactgccaataatttcaaatttagaaggctgagactctataaacaaagactaacaatatgttttctgatatttttccccaaaataatacttttccaagacgaaaatttttccagggtatataagcacatgtgctccaatgatacaacaaatacttactaatcataagcaaataccttaaatgtcttataacatctttcacacaaaagctgttgcatgtctattagctaaaaattcttatgtctcgtccagatcatgcagcatgagcaaagggatttttgaccttcaaaagtctcagtactaactgaggactttacacaaattggaaatggtcacctgcatttcatggtggtggtggggagcttttgcactggaaaatccttctgtagagaagattccattatcttggtaaaattacatagttttattttgcagattgggattaccaactgataaagggttactgatgtggaagttttcctactttattctcctattaggttcctatgtgatatggtttggctctgtgtccccaccccaatctcatctccaattgtaattcccatgtgtccagggagggtccaggtgggagtgattagatcaagggtggtttttcccaggctgttttcatgatagggtgttatcatgagatatgatggtttaaaagtggcaggttcccctgctctctctctcgcctgctgccacataagacgtgccttgctttcccttcaccttctgccatgattgtaagtttcctgaggcctccccagccatgcggaactatgagtcaattaaacctcctctctttataaattacccagtctcaggtagtatctttatagcggtgtgaaaatggactaatacactatggctttgaattaataatttaaaatttgtcagcttggcaataaaacatcctgttgacatttattttttaggtaatattttaaattggcagtttcattcatgtttttacaaattcttattttcagggtgtttaaggcctttgctttgaacttggtggttccttacactccatgctgttagtgaagagggaccaggttgggaggcattggtttgggtggtggtcaggaagggcagagtgatttgagtagggtctgagtggataatagctcatcagtttggaatttataaatgaccagggatgatttaaggagattcctgccagacacctatgccatggccatgccctatctggatctccagccgtgagatgagaacccagccatgcgggggagtctgttcgttctgctcaatgttgtaagtggcacatgctattggataatgtagaattgaatggatatcattttattattataatttacaaacttcctacaataaacttatcacctttatacatagaaacaaatataagtacattttccctcccctatgtcattttgagccctctctccaaaccatcctcccactctgcgactcactgtcctgcatttggctatgctctggcaagtcctgcttagacaagcactcaccagaccacctactcagcctcccttcagcgcccacctggcccacctgctcaaatacatgttgagtggtcacacacatggactgaacaccatctattccatgcactgccccagtgaccgcactgagcagcaagagagaaatgatcgcattagctatcaattatgccaattcaaatgctggagtctttctcagatacttttcaatgttcaagaattgttgattgtgaattctatacccaatgaaactatccttcagaaatgagcagaaaatggataccttctcaaataaacaaaaactaaaagaattcttgctacaagatgtactcttaaagactggctaaaggaagttcttcaaacagcaaggaaattgaattgatcttatgtcctgcacacttgctaaatttcctctcaattttagcagcactgtttagattccataggattttccatacaaacagtcatgtggtctatatatagagacagattttcctcttttccagtggggataaatttatgtctttttctttctgtgttacagcaggtaggacctccagtacaatgttaaacagaagtggtgaaaacagacattcttgcctgtttcctaacgttggagtttggtcttttactatggtgtcagatgttagctgtagggtttttataaatgcccttcatcacattgaggaagtttgctcctatgcctaattttctgagagtcttttaatgtgacactcatgctagaatttattaaatgctttctgtctactaagatgattatgcagttcttatattaacatgaataattacatttatttattctttaatatcaaggcaattttgcattcctgagacaaaccccatttagtcatcatgtgttgttattgttacatattgttggattcaatttcctcaaaatttgttaagaattgttacatctatgtttacaaggaagattagtctgtagggtattttttcttataataactttgcctagttttgcaatcagggtaatgctggactcacagaatgagttgggaagctatttcctcctcttcatttttctgaaagaatttgtataaaattggaattatatcttccttaaaggtttgcaagatttcataatgaagtcattggcctagagttttctttgtgggaaagtctttgtttgtttgttttgtggtttgggtttttttttaagagacacagtctcactctgttgcccaggctggaatgcagtggtgtaatcatagctcacagcagcctcaacctcctgggctcaagcaatcctcctacctcagccttcagagtagctgggactacgggcatgtaccaccacacccagctgtttgtttgtttgtttatcgctttgtcttgtttttgaggtcttattatgttgcccaggctggtcttgaactcctggcctcaagtaatcctcatgcctcagcctcccacagtgctggaattacaggcatgagccactgcacacagactgtgggaaagtttttaactaaaaattcaattttctcttccttttccagtgagctttccagtgtctttcaattaatgtatctattttatctaagttgttgaatttattgtcaaaatttttttaaacaatattcctctcttagaggttgaacatctgtagaatctgtagtgatggcacctcttaaatccctgatcttgctcatctgtgtcgtctctctttctctaatcagtatgcctaaagtttaatttcattgattttcttaaaaaactggttttggttttattgatttttttccctagttttttgtgttacatttcattgacttctgctctgatatttactatttcctttctactgcctacagtaagtttaatttgctattttcttagtttcctaaagtggaagctaagtttattgacttgaggcctttcctctgtctggatgcggatatttgctgctaaacatttccctccaacaccatgctgtgagttttagttacagcgggcttggagttggcctgagaaattctacttaaacagctgcacctatcatgtaagtgataaatgatgtacctgcctggccctcacccctggtcaaagaatgggatgtactaatgagcaatgttgctgcgtagctgtggatttcaaggtattttctgtgtggttttatcatcagcattgtttgttgatgactgcaagactgatgatttgcacctggcctcggtgagatccccgaaagaccctgcagatgggctggttacttagcagaaaatatgacaacgtggccagcaggaaacaggaaggtacaatcggctgcaggtgagctgttggaagtaagttccaattttcctattttgtatttgcattttaatagtgagactgcgcttatgttatttgtgtgaaacagctttattcatagcactgtaatttaaagagaaaacccattcatgggaacaacaaacgacctagacaccaaggtagctcatgccatccaaggctatactgtgcagtgattgggaaaatgggcactggtcccagaagtctgatcgacactctgccactggctagtcccgtgctggggggcgaggatccacactctgccactggttagtcccatgctggggacaagtatccacactctgccactggctagtcccgtgctggggggcgaggatccacactctgccactggttagtcccatgctggggacaagtatccacactctgccactggctagtcccgtgctggggggcaaggatccacactctgccactgattagtgttgtgaagatttaaataaagaacccacaccatattctttgacttgtgctttccgtatactgagagatagtaagagtacattattattatttataaagtaaactagaaagcacatgggaagacaagaagaaaacctgaataaacatgaattaccccattttcctcaggagaaaactttcacactctgaaggtacacaaattagcctacaaatttaatgtaaagcaaatagactgttgtaggtaccaattctcaatgtcacagtgttacatggaaagtaaaatacacaagaacagcccaaaagatggaaacaatggacgtggtcaaatgacatcagtacaacatccatatggtcctaagtagccatctttaaaatgggttagaaatgccttcaatcattcacacagacacatgcattgaacaaactctaagaagtgttcttacacgggaaaagcaagttacagatgcatgggcatgatatggatgtagatgtgtgtatgtgcatcccactcatacacaaaatacccagcatcgcccacatgcctgctgtgtgcgtaagtgtgagcgagtgcacagacaacagcgtgcagaaattcaaaccaagctgtgggtacttgttaccactgggaagggagtcggtcacagagggaaagagaaacaggacatcagcctttgacttcagaactgttcctgccttttcacatcctgtgctgttttcagcatcatcggagcccttaacacacatcacgggagtaagagtgtgttagagggagcattcggtgggacagatattgccatggcttgtggatagagttcacagtccttaataatccccgagatggcagccaagagctacgttctcaatcacgcagcttcaccccagaaactgacagaaacccaacaaccaaaaggtgtccattctgacagcctcagcctgtgctggctcagatgagcaaaaatgtacagatattaataatgatgttgatttgaagagcacagaggggggtatgcatgataagggtccaaatttttaccttaaaaaagaatacatttacttctcaatcacctacataacgatcattttttaaaaaactgatcaaatttggtgttacaagggcacgttgcaaattcttctggctacttttctctgactattctaattacgttaccgtgttttctcctgtatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatttctggctacttttctctgactattctaattacgttaccatggtttctcctatatgtgcccgttcatgtgaatgtcatttctggctacttttctctgactattctaattacgttaccgtgttttctcctgtatgtgcccgttcatgtgaatgtcatttctggctacttttctctgactattctaattacattaccgtgttttcctgtatgtgcccgttcatgtgaatgtcatccaggcagatttcccaaatccggcttcctgtaaccaagggctgaaagagggaacggtttcctgggaatcctttttgcagtttattttacccggaggcagaagcccacggttccgtgaagagtctattgctctcccctctctccttttgtgtctctatttttaattgacaaaaaagcaaatgtgaagattcctggggtacaatgcaaagtgacaatgcctgtctatattgtgggatgattaaaacaaggtaagtggcatatccatcacctcacacacttatcattttgtggtgagaacatttaaaatctcatcttttagcaattttgaaatagtcattattgttaactatagtcaccatgctgtgcaacagatcaaaagaactgactcctcccatcagcagaaacttcatgccctttgaccagcatctctcctttccccgtccacgactaacccccagcccaagagaacagccaacacccacctcgctgctgccacacgacatgtcgggctttgatgggatggaggtgagggtggggaagacaattccaaagctggagcactggcctcacagctcagacactcttctacttatcctgagagaatgatgtgctgagaccaactaaacctcccctgctcttcccacatggcagaaaagaggcaacccagggaagccattgccaggacatcatggtcacccaacccttgtgcagaaaggaagcacctgcccaggatgccatagcacccaaccctcatccccaaggaaacacagcccagggcaccatggacacccaaccgtcatccccaggggaggacacagcccagggcaccatggacacccaaccctcatccccaggggaggacacagcccagggtatcttggacacccagccctcattcctaggggagtacacagcccagggcatcttggacatccaaccctcatccccagggaaggacacagcccagggcatcttggacacccaaccctcattcccataagagcacacagcccagggcatcgtggaggcccgaccctcatccctaggggaggacacagcccagggcaccatggacacccaaccctcatccccaggggaagacacaacccaggccaccattaacacccaatcatgtgcagggagggtgtccttggagcctgggactcttgccagtgaagcggtggacaagaaactgaggatgcgatcagcacacagaaatctcaggcagcctaggatacatgaggcctctcacccctgggaacactgagcagccaccaggagcccacaccttgaggtacagcaggagccatgcgctcttgctcttgctcactcacactcctgcacacagccactgacacacgccctcgtgcacgttgcagattaactccactggccttgcacttgcaacgctggaggctgagaggtatccccaggttcttttctcgtgagaggggcaggctgactttcactctcctccatgtgctagaggcagctccaccaacactggctgccctgagtggatgcacctggctctggaattcctgtcatttgctttggatccaggagcccctgcctcatgtagctacttaacagaaaggaggaatccacccaggacatgcccagacgggagcctcacaggatggacagtggtgtctggggtcacgggcagccctgacccagcagcgccagcaccagcacacccagtggggaaggcggggaggcccaaacgccacccacagtttgttactccactgggtgggacccggcacccctgccttcctgacaccctggagtccctgcctcctcctagagcccccaagcccatctgcctcagagcatccagagacagacctggggagccatttcctcaggccctggacaaggaaacagggaattccaggttatgggtgcctggggcaggtctcaggcaggtgctgggaaccagagagaggggtcaccgcgaggcctcaggcctggcaccagcactttgagcctcagtttaccagcccacgaggtgctgagtctggactggatgaccttcccacccccagtgacctctgccctttcccgagcatgtcagctctgctccagcatcctggtgtgagcgcaatgccactttttttctcaacaaatacgaaaggaggaaggtgcccccagggccctgtgccctgaggatgcctgtgtggaggggtccatttcatcactggtgtcactcacaggaagggacgaagccacctgccttgacggagcttactccacctccgccgaaggccggggaggtccctcacagagaacctgaggcccagcaggctgcagaggtgctggcatggaatgactgctcagacgcccggggccggcagagaggacggatgtgggggaggtgcacactgaggagcctctccttggaggtggagacacgtgcaccacatggaccaggacacagtccacgaagcctcgcatccccctgagctgcagctcaagggcctctctctgagcccagagtcccacccctgggaggcagctgccccagctctgagggaggagggcatccaccaggccctccatctcctgggggcaccagcccagcccagaggctctgcaggactctgcacctccaattcatggccaggactttctggatgtatcttaaggactgaggactccacatcagggaccacacaagaccggggtcccggacacgggggttgggggtgagcatgtcaccgggatgggctgtggcgtcactctggtacttcatccggacagccagggaccaaagccacgccctcagccccaccccacccctgcctcacatggcaacgcagggtctgcagatgcaggagagtgagaagcatggtagccaggcagactagaggacccgagctggggttgagcacctccctgtctacccagggcatggcctgtgagactgcaggtggcctagtgtgtgctgcaggctcaaggtcctgccccagggagcatgacattcaggcccagaaattgcatcgtgctgcacacagtccaaggggataaccctgtgaagttcaggtcaccagcaggcttggggtcaagaccgagctgcagaggacaggtttctggaaggcacagcatcatgggtggagggacttggagcaaggtccttagccccgggaccagtgaatgtgtgcccttatagggaaagggggtctgtgcagaagcaagttagctgaaaatcatgaagtggagaggctcccctggattaaaggggtgagccctaatgtaatcacaagtgtccttctaggaggttggcagagggagactgacatagacagaagccaggtgaggtgggaagcggaggcagaggccgagagagcagacgctacgccctggccctgaagacggaggaggagccgagagctcagggatggagagactggaggaggcagggaagttctccccgcaagcctggagggagcatggcctccagcacccccagaccttggccctgcaggattcatctggacctgtggtataaatggtgtttaagccactgggctgtgcaaattgtcatagcagccatggcgcattcctagagggagccctggtggggacccagcaggcagcgacggggccctcacaagcctgtgagccactcagagccgcgagagtggctaggcttggtgaggtgcaggccacgcgcacctccactaaggcagccttagggcccacacttcctctctctctctctctctctctatctctctccctccctccttccctccctcccgctctcttggttggacagctctccatcatccccctggacatgaccacctcccaaggccgagctggggcgctttgctcgaggtgagcactgacatcctgggggtgtgaggggcacctgcccagcggccccgtgtgcaggatgggcggtgggccctagctggcactgggcatatggcccggctggtgcctgcaggctgcagcttttctggggtggctgggatcagtgaaggcctccagagtctgggcctgggatccctgcagtgctggctgaggacaggcggggctgggcagtgagggcactgggtcactatcaccacccacggtttattacttcactaggtgggacctggcacccctgccttcctgacaccctggaatccctgcctcctcctacagcccccaagcccatctccctcagagcctccagagacagacctggggaggcatttcttctgcccccagcagaagcccgggaggccgggaaggcacagtgggtctaaaggagaggatcccaggactgcctgaggggtgactccgacgaggcaagcatagagcccactgagaagcggggtgggagccccaccagggatgggctagttcctcatgaaggaccaggacccaggaaggacaagggggcctgctggggcagggtctgctatgccggagtccctgtgagcctggcccagacctgcctctctctttcctcattggtccccacaggtccgtggtggttgccgtatcgggaggccccatggtggcaggggtgggacacctggtatacgtcgccaggtgtgtccaataggctcatgctcacaccttctcctggcacctgggcaaagcctgagcacccaggcactgaagtgagggcaaggcctcggggccccacaggatggccgaggagacagctgcagggcgcctgggacccctgggctcaggaggtagaaggatacagcctgaaaacccacaccacaagctcaccggccagtgcaggcccacagagctcgaggaggcagccctgagcctcccagggagagatgctctgtgcacgccggcacaggccctgggttacaaaccctaggcacagcccaggagaggcccaggccccagtccagcaaggggttgcaggaagcaagaggtccccggccacagcatgagataagcccatcaagccagggccaggtgggcaatgggaggcaggcagggcttgggggtgagtccctgctgcagcgccgtccactgtcgaccggaggagtttcttccctgtgcggagtccacgggcctcctgtgagtgtgtgcatgggcacaagtgtgtgtgtggctctgctgtgtgtctgtacacacatatgttttgggtttttttgtgtctcagaccacagagtctgcccctcccaccaaagcccaggcagaaggatgaacccacgcccctggggcccaggcctcagcagcctctgcgggatcattgttcccagttgtcacttgcctttgccacagccctatttctccacaattccttaaagtcctcaacatgcatttaaggcacaaaggtgaaactgcccagaaacatctgactccgccgtggaacccaggagcaagctgggttagctaaggagcggggccgttggcagaggctggggatccaggctgaactttggaggaggcatgtcccagcatgggctcctgactatgtcctcctgggacaaacccaaacccgctctttgaatatgggagggactttgctggccccggccctgaccgcagcacttggaaactgaggagtggtcgcctcctccgtgtcacagctgcccgttcaccatcatagaagcaactctgtcacctccatgggcccctctgtggctgctgcctgggtccaagctgagcccagctgcccaggcccagaaggaaagcccaggccaggtgcccagcacagaggcagtcacataccccggggagagccacagcaagcagccaatattgcccaggagaggagtagctgacaaggcagaacgtgagctgccatcggctcgagaggctttgctggtcctcctggggctctggacatgaccaggaggagcgagggaagaagtcgcatggtggtcccatcctgggtggggcctgatggcagctggccacccgtcccagagtggcagccagatgccagcgccattcccacagtcacatcattggtcacagaatgcaggacatagagtgtcttctttccatcacagtgctgtccagacccatagcctagggtagacctggaagattcaatgtccacacccggggctggagcgtagccatgagccacgccccctgcccgtgcatggaaagccagcccaagctctgctccatccctagccaaagtcagtgtcctttccccttctcccaagtgagctctagccacctgcctaccctgccatctgaggatgacagccttcattccattggaacctggctctgccaccagcaggcttgcagtcctgggcagactccgtcacctctctatgcctcagcctttccatctgcacaggaggaagatgatgatggtggtgatgatgatggcgatggtttccttttgcatctgaggcaaggactaattgagatgatacacatcaggcactgggtatggtgctggtccttcctgagcactcaatctatgtgagctgtccttgtgaaatgggtgtcaccacatttccccacgcagaacatcctttgtctgccatacttgaaacgtctgccccaatactaacagctcctcatggaagatgtgcacacccacccaccctcatactcccaaaggtgcccgtgctttatcaagccaaagtccagccaggaactttacagcagcatccctttccctctccaagcaccaaggagcaaggcaaagcactacatcttccatctggaggcaatgccaccctcttctcccattttcactgccatccctaagaggcagtgcttccccaaaaggttccatagcagcctgcctacagcaactctgttcacacgagtttcagcatccttgcagtggctcccctgccatgctgtggctcttcattcaccctcttctcctgctccccgtgacaggcatagattctgagtgatctggatacattgctttgtttaataacattacagcttctgtgctgaaaaagatacagcagatagagaaggcaattgttgaacacaaaatagtgacagcagagatgacggcaagttggcatttttcttttctagcaataaaacttaaagctgactcaaggagaaatggaaatcataattggaacagtaatcctcaagaaagcattaagattattaaataattgccctcacagatgacttcaggccaagatggctttatgggtgaagtttagactttcacaaaactaatcagttcccataagaactgctccaggatttggaggaacatgggaaagtctattaaagggatcacaattcacagtccccagagtaaaacatgggctaacttgcattttggcaaagagccaaatgttataaatgacatcctagaaggccaaattctgtccatctcgttgaacaaggacttacaccaggaatttagaactatttatagctcatcccaccactcaggccaatgatgacccatgatcatctcaccagaaatggaaagactcagatgattaatagagtctcaatttctctgagacatctaagagcccagcccaagcccagacccaggagggcacccaggcctggacagagaacactgatatcacaccagccctccagagggaagcagagactccttcaagctctggaaacacaggcccagacagctgcccaaagttgggcaggcttcactgcaaacccaaatcatgaagctaggtaacacctttacagattctttacatttaaaaatcatcaaaacaagagtaaataataaactcaaataatattaatctaatatgtaaaggtcttgtaccattattatgcaaacaacatacataagctaataagaaaaagaacaaatcccttaagaaatcggcaaaaaggatataacacaatttctaaaagaaaacaaatggctagcacacataaggaaaacactttgtgaacagacattcttcagaacattatttataattataaaatagttgaaagcaagatagtgcctgaagaaattatggtgcatacattagtgggactattctgcaaacattcccaattatacttgtcacatatctgtgataacgtgacagccagcattcatggggtgacctcatttggtaaaagggtgcaaagctcaacacgcattgtgagatgactgtggtgtaaaattagtgggattattccgcaaacattcccaattatacttaccgcatatctgtgataacatgacagcattcatggggtgacctcatttggtaaaagggtgcaaagctcaacacgcattgtgagatgactggtgtaaatacaaagaccaaactgtgaaaaggagtccatcaattaatcgatgcttaccttcagttttgggctaatttttaaagtatgctataagcatatgctcctgttataacagaatggagggattatgagagatgatgcaggtgtgtcctgggcctcccctggcccactgggccctagagatgccttcccaggcatcgctgtcagggcttccctcagagggagtcctgtattgacctcaccaccaaggtctggagcaggggatccttagatattggttggggttatctcaccttaggtctgaatatggggttgtcttagactgttttgtgctgttagaatagaatacccaagactgggaaatttatactgaacggaaatttatttctcacagttctagaggctgtgaagtccaagagcacaggtgccagagcaagtccaagagcaagggaaagtccaaagcaagtccaggagcatctggcgaggaccttcttgctgtgtcatcacatggcggaaggcaagaaagagagcaagagggggccgaactcacccttttataacagcaccaatcccacccatgaggtggggaccttatgacctaatcactcttcatactgttacaatggcaatgaaatttcaacatgagttttggaggagagaagcattcaaaccacagcaagggtgctcctacctcctctctcagggcatctgcagaaagagctgcaactgcacgtccttcctccgtccatcctccatcccttcccaatgtccgtgcatatcctgtgacccaggaggtctggcatagggggtgctcctgccttaggtctgaggccctgtctgaagaggggtaggtgaggaggccatctgatggtctgggccaagacagtcacaggacgcatcatttatcatcaaggaggctgagggttgagtctccaggtccagggaactccccacaaagtgggaaccctgcccagctccacacagcctctgctgggggaccctgctctggtgcagagcctggggacaggtcttgagctcagccagagtctgcctccctgtcatttaggaactaaaccaagcggcaggatgctggagcccagcccccatctgaccttacagggccaaggctggggccctgggttcccctcaaggcgcagcaggactggagccccaggcagtgcaggagtggccaaagctggggcttcctccagagcccccaagcatcacggcaccaagaagggtaggaccctggcctgaggaattggcaccaaagccccagaaactaccctggacaccatggagagaggcctggaggggaagcaccaggcactgcctccccttctgatcccacctgaggtggctgccaagcccagagagccgctctgatgtcccccagccctgcagcccagggatacctgtactgtgcccctgggggacccctggccagtctgtgcaaagaagtcaccaccctacactcagagacagtgggggtcctcgtcccacatcctcagagcatggcccggctgctgcagggatggtctcctggtcctcagagcatggcccggctgctgcagggatggtctcctggtcctcagagcatggcccagctgctgcagggatggtctcctggaggccccccagtgctctattgtcagggctccctccacccccccgcaccaagagagagccagaccccagcaaggcttccagtggcttcaggtcacacccctaggctgaccccagccccattaacacctgcctgagaaagctccacgcaccagaactgaccgtctgctccaactcttgacctcccgttctcagggcgtctgctgaaaaggctgcaactgcacatccttcctccgtccgttcccgatgtccgtgtgtctcctgtggccaggaaggtctttctcgggacctgagagccgctccctgaagtgtccccattgggaaggatggggcctgtgtctccaggctctgggaggacagaatcctgacctcaacagtggccggcacggacacaactggccccatcccggggacgctgaccagcgctgggcaacttttcccttccccgacgactgagccccgagcaccctccctgctcccctaccacctccctttacaaggctgtggcctctgcacagatgataatggagcttggctcattcccctagagtcggtagggagttaaggacaaaactcagtttcctccacctgaactcaagtctgcctatgtttacctaatcacacctggtggacagtttggacaaacttgcacactcagagacacagacacttctagaaatcattatctccctgccccggggaccccactccagcagaagtctgctaggcactggcctgggccctcctgctgtcctaggaggctgctgacctcctgcctggctcctgtccccaggtccagagtcagagcagactccagggacgctgcaggctaggaagccgccccctccaggccagggtctagtgcaggtgcccaggacaagaaagattgtgaatgcaggaatgactgggccacacccctcccgtgcacgccccctcttgccctgcaccccacagcccagccccccgtgctggatgcccccccacagcagaggtgctgttctgtgatcccctgggaaagacgccctcaacctccaccctgtcccacggcccaaggaagacaagacacaggccctctcctcacagtctccccacctggctcctgctgggaccctcaaggtgtgaacagggaggatggttgtctgggtggcccctaggagcccagatcttcactctacagaccccaacccaagcacccccttctgcagggcccagctcatccccctcctcctccctctgctctcctctcgtcgcctctacgggaaatccgggactcagcagtaaccctcaggaagcagggcccaggcgccgtttaataggaggcttcctcacaatgaaacttttagaaagccttgactacaatgatgaccttggtgtggctgtgaacactgtcagctcccacagctgctgcagcaaaaaatgtccatagacagggtgggggcccggggtcgtctgctgtcctgctcagcccacagcacgcatggaggatctgaggtgccacacctgacgcccaggccagaacatgcctccctccagggtgacctgccatgtcctgcattgctggagggacaggggcagcctatgaggatctggggccaggagatgaatcctattaacccagaggaaaactaacaggacccaagcaccctccccgttgaagctgacctgcccagaggggcctgggcccaccccacacaccggggcggaatgtgtacaggccccggtctctgtgggtgttccgctaactggggctcccagtgctcaccccacaactaaagcgagccccagcctccagagcccccgaaggagatgccgcccacaagcccagcccccatccaggaggccccagagctcagggcgccggggcagattctgaacagccccgagtcacggtgggtacaactggaacgaccaccgtgagaaaaactgtgtccaaaactgtctcctggcccctgctggaggccgcgccagagaggggagcagccgccccgaacctaggtcctgctcagctcacacgacccccagcacccagagcacaacggagtccccattgaatggtgaggacggggaccagggctccagggggtcatggaaggggctggaccccatcctactgctatggtcccagtgctcctggccagaactgaccctaccaccgacaagagtccctcagggaaacgggggtcactggcacctcccagcatcaaccccaggcagcacaggcataaaccccacatccagagccgactccaggagcagagacaccccagtaccctgggggacaccgaccctgatgactccccactggaatccaccccagagtccaccaggaccaaagaccccgcccctgtctctgtccctcactcaggacctgctgcggggcgggccatgagaccagactcgggcttagggaacaccactgtggccccaacctcgaccaggccacaggcccttccttcctgccctgcggcagcacagactttggggtctgtgcagagaggaatcacagaggccccaggctgaggtggtgggggtggaagacccccaggaggtggcccacttcccttcctcccagctggaacccaccatgaccttcttaagataggggtgtcatccgaggcaggtcctccatggagctcccttcaggctcctccccggtcctcactaggcctcagtcccggctgcgggaatgcagccaccacaggcacaccaggcagcccagacccagccagcctgcagtgcccaagcccacattctggagcagagcaggctgtgtctgggagagtctgggctccccaccgcccccccgcacaccccacccacccctgtccaggccctatgcaggagggtcagagccccccatggggtatggacttagggtctcactcacgtggctcccctcctgggtgaaggggtctcatgcccagatccccacagcagagctggtcaaaggtggaggcagtggccccagggccaccctgacctggaccctcaggctcctctagccctggctgccctgctgtccctgggaggcctggactccaccagaccacaggtccagggcaccgcccataggtgctgcccacactcagttcacaggaagaagataagctccagacccccaagactgggacctgccttcctgccaccgcttgtagctccagacctccgtgcctcccccgaccacttacacacgggccagggagctgttccacaaagatcaaccccaaaccgggaccgcctggcactcgggccgctgccacttccctctccatttgttcccagcacctctgtgctccctccctcctccctccttcaggggaacagcctgtgcagcccctccctgcaccccacaccctggggaggcccaaccctgcctccagccctttctcccccgctgctcttcctgcccatccagacaaccctggggtcccatccctgcagcctacaccctggtctccacccagacccctgtctctccctccagacacccctcccaggccaaccctgcacatgcaggccctccccttttctgctgccagagcctcagtttctaccctctgtgcctaccccctgcctcctcctgcccacaactcgagctcttcctctcctggggcccctgagccatggcactgaccgtgcactcccacccccacactgcccatgccctcaccttcctcctggacactctgaccccgctcccctcttggacccagccctggtatttccaggacaaaggctcacccaagtcttccccatgcaggcccttgccctcactgcccggttacacggcagcctcctgtgcacagaagcagggagctcagcccttccacaggcagaaggcactgaaagaaatcggcctccagcaccctgatgcacgtccgcctgtgtctctcactgcccgcacctgcagggaggctcggcactccctgtaaagacgagggatccaggcagcaacatcatgggagaatgcagggctcccagacagcccagccctctcgcaggcctctcctgggaagagacctgcagccaccactgaacagccacggagcccgctggatagtaactgagtcagtgaccgacctggagggcaggggagcagtgaaccggagcccagaccatagggacagagaccagccgctgacatcccgagcccctcactggcggccccagaacaccgcgtggaaacagaacagacccacattcccacctggaacagggcagacactgctgagcccccagcaccagccctgagaaacaccaggcaacggcatcagagggggctcctgagaaagaaaggaggggaggtctccttcaccagcaagtacttcccttgaccaaaaacagggtccacgcaactcccccaggacaaaggaggagccccctgtacagcactgggctcagagtcctctcccacacaccctgagtttcagacaaaaaccccctggaaatcatagtatcagcaggagaactagccagagacagcaagaggggactcagtgactcccgcggggacaggaggattttgtgggggctcgtgtcactgtgaggatattgtagtagtaccagctgctatacccacagtgacacagccccattcccaaagccctgctgtaaacgcttccacttctggagctgaggggctggggggagcgtctgggaagtagggcctaggggtggccatcaatgcccaaaacgcaccagactcccccccagacatcaccccactggccagtgagcagagtaaacagaaaatgagaagcagctgggaagcttgcacaggccccaaggaaagagctttggcgggtgtgcaagaggggatgcgggcagagcctgagcagggccttttgctgtttctgctttcctgtgcagatagttccataaactggtgttcaagatcgatggctgggagtgagcccaggaggacagtgtgggaagggcacagggaaggagaagcagccgctatcctacactgtcatctttcaagagtttgccctgtgcccacaatgctgcatcatgggatgcttaacagctgatgtagacacagctaaagagagaatcagtgaaatggatttgcagcacagatctgaataaattctccagaatgtggagccacacagaagcaagcacaaggaaagtgcctgatgcaagggcaaagtacagtgtgtaccttcaggctgggcacagacactctgaaaagccttggcaggaactccctgcaacaaagcagagccctgcaggcaatgccagctccagagccctccctgagagcctcatgggcaaagatgtgcacaacaggtgtttctcatagccccaaactgagaatgaagcaaacagccatctgaaggaaaacaggcaaataaacgatggcaggttcatgaaatgcaaacccagacagccagaaggacaacagtgagggttacaggtgactctgtggttgagttcatgacaatgctgagtaattggagtaacaaaggaaagtccaaaaaatactttcaatgtgatttcttctaaataaaatttacagccggcaaaatgaactatcttcttaagggataaactttccactaggaaaactataaggaaaatcaagaaaaggatgatcacataaacacagtggtcgttacttctactggggaaggaagagggtatgaactgagacacacagggttggcaagtctcctaacaagaacagaacaaatacattacagtaccttgaaaacagcagttaaaattctaaattgcaagaagaggaaaatgcacacagctgtgtttagaaaattctcagtccagcactgttcataatagcaaagacattaacccaggttggataaataaacgatgacacaggcaattgcacaatgatacagacatacattcagtatatgagacattgatgatgtatccccaaagaaatgactttaaagagaaaaggcctgatatgtggtggcactcacctccctgggcatccccggacaggctgcaggcacactgtgtggcagggcaggctggtacctgctggcagctcctggggcctgatgtggagcaggcacagagccgtatccccccgaggacatatacccccaaggacggcacagttggtacattccggagacaagcaactcagccacactcccaggccagagcccgagagggacgcccatgcacagggaggcagagcccagctcctccacagccagcagcacccgtgcaggggccgccatctggcaggcacagagcatgggctgggaggaggggcagggacaccaggcagggttggcaccaactgaaaattacagaagtctcatacatctacctcagccttgcctgacctgggcctcacctgacctggacctcacctggcctggacctcacctggcctagacctcacctctgggcttcacctgagctcggcctcacctgacttggaccttgcctgtcctgagctcacatgatctgggcctcacctgacctgggtttcacctgacctgggcttcacctgacctgggcctcatctgacctgggcctcactggcctggacctcacctggcctgggcttcacctggcctcaggcctcatctgcacctgctccaggtcttgctggaacctcagtagcactgaggctgcaggggctcatccagggttgcagaatgactctagaacctcccacatctcagctttctgggtggaggcacctggtggcccagggaatataaaaagcctgaatgatgcctgcgtgatttgggggcaatttataaacccaaaaggacatggccatgcagcgggtagggacaatacagacagatatcagcctgaaatggagcctcagggcacaggtgggcacggacactgtccacctaagccaggggcagacccgagtgtccccgcagtagacctgagagcgctgggcccacagcctcccctcggtgccctgctacctcctcaggtcagccctggacatcccgggtttccccaggcctggcggtaggtttggggtgaggtctgtgtcactgtggtattacgatttttggagtggttattatacccacagtgtcacagagtccatcaaaaacccatccctgggaaccttctgccacagccctccctgtggggcaccgccgcgtgccatgttaggattttgactgaggacacagcaccatgggtatggtggctaccgcagcagtgcagcccgtgacccaaacacacagggcagcaggcacaacagacaagcccacaagtgaccaccctgagctcctgcctgccagccctggagaccatgaaacagatggccaggattatcccataggtcagccagacctcagtccaacaggtctgcatcgctgctgccctccaataccagtccggatggggacagggctggcccacattaccatttgctgccatccggccaacagtcccagaagcccctccctcaaggctgggccacatgtgtggaccctgagagccccccatgtctgagtaggggcaccaggaaggtggggctggccctgtgcactgtccctgcccctgtggtccctggcctgcctggccctgacacctgggcctctcctgggtcatttccaagacagaagacattcccaggacagctggagctgggagtccatcatcctgcctggccgtcctgagtcctgcgcctttccaaacctcacccgggaagccaacagaggaatcacctcccacaggcagagacaaagaccttccagaaatctctgtctctctccccagtgggcaccctcttccagggcagtcctcagtgatatcacagtgggaacccacatctggatcgggactgcccccagaacacaagatggcccacagggacagccccacagcccagcccttcccagacccctaaaaggcgtcccaccccctgcatctgccccagggctcaaactccaggaggactgactcctgcacaccctcctgccagacatcacctcagcccctcctggaagggacaggagcgcgcaagggtgagtcagaccctcctgccctcgatggcaggcggagaagattcagaaaggtctgagatccccaggacgcagcaccactgtcaatgggggccccagacgcctggaccagggcctgcgtgggaaaggcctctgggcacactcaggggctttttgtgaagggtcctcctactgtgtgactacagtaactaccacagtgatgaacccagcagcaaaaactgaccggactcccaaggtttatgcacacttctccgctcagagctctccaggatcagaagagccgggcccaagggtttctgcccagaccctcggcctctagggacatcttggccatgacagcccatgggctggtgccccacacatcgtctgccttcaaacaagggcttcagagggctctgaggtgacctcactgatgaccacaggtgccctggccccttccccaccagctgcaccagaccccgtcatgacagatgccccgattccaacagccaattcctggggccaggaatcgctgtagacaccagcctccttccaacacctcctgccaattgcctggattcccatcccggttggaatcaagaggacagcatcccccaggctcccaacaggcaggactcccacaccctcctctgagaggccgctgtgttccgtagggccaggctgcagacagtccccctcacctgccactagacaaatgcctgctgtagatgtccccacctggaaaataccactcatggagcccccagccccaggtacagctgtagagagagtctctgaggcccctaagaagtagccatgcccagttctgccgggaccctcggccaggctgacaggagtggacgctggagctgggcccatactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctctctattccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccagctcacctgcttctcctggggctctcaaggctgctgttttctgcactctcccctctgtggggagggttccctcagtgggagatctgttctcaacatcccacggcctcattcctgcaaggaaggccaatggatgggcaacctcacatgccgcggctaagatagggtgggcagcctggcggggacaggacatcctgctggggtatctgtcactgtgcctagtggggcactggctcccaaacaacgcagtccttgccaaaatccccacggcctcccccgctaggggctggcctgatctcctgcagtcctaggaggctgctgacctccagaatggctccgtccccagttccagggcgagagcagatcccaggccggctgcagactgggaggccaccccctccttcccagggttcactgcaggtgaccagggcaggaaatggcctgaacacagggataaccgggccatcccccaacagagtccaccccctcctgctctgtaccccgcaccccccaggccagcccatgacatccgacaaccccacaccagagtcactgcccggtgctgccctagggaggacccctcagcccccaccctgtctagaggactggggaggacaggacacgccctctccttatggttcccccacctggctctggctgggacccttggggtgtggacagaaaggacgcttgcctgattggcccccaggagcccagaacttctctccagggaccccagcccgagcacccccttacccaggacccagccctgcccctcctcccctctgctctcctctcatcaccccatgggaatccagaatccccaggaagccatcaggaagggctgagggaggaagtggggccactgcaccaccaggcaggaggctctgtctttgtgaacccagggaggtgccagcctcctagagggtatggtccaccctgcctatggctcccacagtggcaggctgcagggaaggaccagggacggtgtgggggagggctcagggccccgcgggtgctccatcttggatgagcctatctctctcacccacggactcgcccacctcctcttcaccctggccacacgtcgtccacaccatcctaagtcccacctacaccagagccggcacagccagtgcagacagaggctggggtgcaggggggccgactgggcagcttcggggagggaggaatggaggaaggggagttcagtgaagaggcccccctcccctgggtccaggatcctcctctgggacccccggatcccatcccctccaggctctgggaggagaagcaggatgggagaatctgtgcgggaccctctcacagtggaatacctccacagcggctcaggccagatacaaaagcccctcagtgagccctccactgcagtgctgggcctgggggcagccgctcccacacaggatgaacccagcaccccgaggatgtcctgccagggggagctcagagccatgaaggagcaggatatgggacccccgatacaggcacagacctcagctccattcaggactgccacgtcctgccctgggaggaacccctttctctagtccctgcaggccaggaggcagctgactcctgacttggacgcctattccagacaccagacagaggggcaggccccccagaaccagggatgaggacgccccgtcaaggccagaaaagaccaagttgcgctgagcccagcaagggaaggtccccaaacaaaccaggaagtttctgaaggtgtctgtgtcacagtggagtatagcagctcgtcccacagtgacactcgccaggccagaaaccccatcccaagtcagcggaatgcagagagagcagggaggacatgtttaggatctgaggccgcacctgacacccaggccagcagacgtctcctgtccacggcaccctgccatgtcctgcatttctggaagaacaagggcaggctgaagggggtccaggaccaggagatgggtccgctctacccagagaaggagccaggcaggacacaagccccctccccattgaggctgacctgcccagagggtcctgggcccacccaacacaccggggcggaatgtgtgcaggcctcggtctctgtgggtgttccgctagctggggctcacagtgctcaccccacacctaaaacgagccacagcctccggagcccctgaaggagaccccgcccacaagcccagcccccacccaggaggccccagagcacagggcgccccgtcggattctgaacagccccgagtcacagtgggtataactggaactaccactgtgagaaaagcttcgtccaaaacggtctcctggccacagtcggaggccccgccagagaggggagcagccaccccaaacccatgttctgccggctcccatgaccccgtgcacctggagccccacggtgtccccactggatgggaggacaagggccgggggctccggcgggtcggggcaggggcttgatggcttccttctgccgtggccccattgcccctggctggagttgacccttctgacaagtgtcctcagagagtcagggatcagtggcacctcccaacatcaaccccacgcagcccaggcacaaaccccacatccagggccaactccaggaacagagacaccccaataccctgggggaccccgaccctgatgactcccgtcccatctctgtccctcacttggggcctgctgcggggcgagcacttgggagcaaactcaggcttaggggacaccactgtgggcctgacctcgagcaggccacagacccttccctcctgccctggtgcagcacagactttggggtctgggcagggaggaacttctggcaggtcaccaagcacagagcccccaggctgaggtggccccagggggaaccccagcaggtggcccactacccttcctcccagctggaccccatgtcttccccaagataggggtgccatccaaggcaggtcctccatggagcccccttcaggctcctctccagaccccactgggcctcagtccccactctaggaatgcagccaccacgggcacaccaggcagcccaggcccagccaccctgcagtgcccaagcccacaccctggaggagagcagggtgcgtctgggaggggctgggctccccacccccacccccacctgcacaccccacccacccttgcccgggccccctgcaggagggtcagagcccccatgggatatggacttagggtctcactcacgcacctcccctcctgggagaaggggtctcatgcccagatccccccagcagcgctggtcacaggtagaggcagtggccccagggccaccctgacctggcccctcaggctcctctagccctggctgccctgctgtccctgggaggcctgggctccaccagaccacaggtctagggcaccgcccacactggggccgcccacacacagctcacaggaagaagataagctccagacccccaggcccgggacctgccttgctgctacgacttcctgccccagacctcgttgccctcccccgtccacttacacacaggccaggaagctgttcccacacagaccaaccccagacggggaccacctggcactcaggtcactgccatttccttctccattcacttccaatgcctctgtgcttcctccctcctccttccttcgggggagcaccctgtgcagctcctccctgcagtccacaccctggggagacccgaccctgcagcccacaccctggggagacctgaccctcctccagccctttctcccccgctgctcttgccacccaccaagacagccctggggtcctgtccctacagcccccacccagttctctacctagacccgtcttcctccctctaaacacctctcccaggccaaccctacacctgcaggccctcccctccactgccaaagaccctcagtttctcctgcctgtgcccacccccgtgctcctcctgcccacagctcgagctcttcctctcctagggcccctgagggatggcattgaccgtgccctcgcacccacacactgcccatgccctcacattcctcctggccactccagccccactcccctctcaggcctggctctggtatttctgggacaaagccttacccaagtctttcccatgcaggcctgggcccttaccctcactgcccggttacagggcagcctcctgtgcacagaagcagggagctcagcccttccacaggcagaaggcactgaaagaaatcggcctccagcgccttgacacacgtctgcctgtgtctctcactgcccgcacctgcagggaggctcggcactccctctaaagacgagggatccaggcagcagcatcacaggagaatgcagggctaccagacatcccagtcctctcacaggcctctcctgggaagagacctgaagacgcccagtcaacggagtctaacaccaaacctccctggaggccgatgggtagtaacggagtcattgccagacctggaggcaggggagcagtgagcccgagcccacaccatagggccagaggacagccactgacatcccaagccactcactggtggtcccacaacaccccatggaaagaggacagacccacagtcccacctggaccagggcagagactgctgagacccagcaccagaaccaaccaagaaacaccaggcaacagcatcagagggggctctggcagaacagaggaggggaggtctccttcaccagcaggcgcttcccttgaccgaagacaggatccatgcaactcccccaggacaaaggaggagccccttgttcagcactgggctcagagtcctctccaagacacccagagtttcagacaaaaaccccctggaatgcacagtctcagcaggagagccagccagagccagcaagatggggctcagtgacacccgcagggacaggaggattttgtgggggctcgtgtcactgtgaggatattgtactaatggtgtatgctatacccacagtgacacagccccattcccaaagccctactgcaaacgcattccacttctggggctgaggggctgggggagcgtctgggaaatagggctcaggggtgtccatcaatgcccaaaacgcaccagactcccctccatacatcacacccaccagccagcgagcagagtaaacagaaaatgagaagcaagctggggaagcttgcacaggccccaaggaaagagctttggcgggtgtgtaagaggggatgcgggcagagcctgagcagggccttttgctgtttctgctttcctgtgcagagagttccataaactggtgttcgagatcaatggctgggagtgagcccaggaggacagcgtgggaagagcacagggaaggaggagcagccgctatcctacactgtcatctttcgaaagtttgccttgtgcccacactgctgcatcatgggatgcttaacagctgatgtagacacagctaaagagagaatcagtgagatggatttgcagcacagatctgaataaattctccagaatgtggagcagcacagaagcaagcacacagaaagtgcctgatgcaaggacaaagttcagtgggcaccttcaggcattgctgctgggcacagacactctgaaaagccctggcaggaactccctgtgacaaagcagaaccctcaggcaatgccagccccagagccctccctgagagcctcatgggcaaagatgtgcacaacaggtgtttctcatagccccaaactgagagcaaagcaaacgtccatctgaaggagaacaggcaaataaacgatggcaggttcatgaaatgcaaacccagacagccacaagcacaaaagtacagggttataagcgactctggttgagttcatgacaatgctgagtaattggagtaacaaagtaaactccaaaaaatactttcaatgtgatttcttctaaataaaatttacaccctgcaaaatgaactgtcttcttaagggatacatttcccagttagaaaaccataaagaaaaccaagaaaaggatgatcacataaacacagtggtggttacttctgctggggaaggaagagggtatgaactgagatacacagggtgggcaagtctcctaacaagaacagaacgaatacattacagtaccttgaaaacagcagttaaacttctaaattgcaagaagaggaaaatgcacacagttgtgtttagaaaattctcagtccagcactgttcataatagcaaagacattaacccaggtcggataaataagcgatgacacaggcaattgcacaatgatacagacatatatttagtatatgagacatcgatgatgtatccccaaataaacgactttaaagagataaagggctgatgtgtggtggcattcacctccctgggatccccggacaggttgcaggctcactgtgcagcagggcaggcgggtacctgctggcagttcctggggcctgatgtggagcaagcgcagggccatatatcccggaggacggcacagtcagtgaattccagagagaagcaactcagccacactccccaggcagagcccgagagggacgcccacgcacagggaggcagagcccagcacctccgcagccagcaccacctgcgcacgggccaccaccttgcaggcacagagtgggtgctgagaggaggggcagggacaccaggcagggtgagcacccagagaaaactgcagacgcctcacacatccacctcagcctcccctgacctggacctcactggcctgggcctcacttaacctgggcttcacctgaccttggcctcacctgacttggacctcgcctgtcccaagctttacctgacctgggcctcaactcacctgaacgtctcctgacctgggtttaacctgtcctggaactcacctggccttggcttcccctgacctggacctcatctggcctgggcttcacctggcctgggcctcacctgacctggacctcatctggcctggacctcacctggcctggacttcacctggcctgggcttcacctgacctggacctcacctggcctcgggcctcacctgcacctgctccaggtcttgctggagcctgagtagcactgagggtgcagaagctcatccagggttggggaatgactctagaagtctcccacatctgacctttctgggtggaggcagctggtggccctgggaatataaaaatctccagaatgatgactctgtgatttgtgggcaacttatgaacccgaaaggacatggccatggggtgggtagggacatagggacagatgccagcctgaggtggagcctcaggacacaggtgggcacggacactatccacataagcgagggatagacccgagtgtccccacagcagacctgagagcgctgggcccacagcctcccctcagagccctgctgcctcctccggtcagccctggacatcccaggtttccccaggcctggcggtaggtttagaatgaggtctgtgtcactgtggtattacgatattttgactggttattataaccacagtgtcacagagtccatcaaaaacccatgcctggaagcttcccgccacagccctccccatggggccctgctgcctcctcaggtcagccccggacatcccgggtttccccaggctgggcggtaggtttggggtgaggtctgtgtcactgtggtattactatggttcggggagttattataaccacagtgtcacagagtccatcaaaaacccatccctgggagcctcccgccacagccctccctgcaggggaccggtacgtgccatgttaggattttgatcgaggagacagcaccatgggtatggtggctaccacagcagtgcagcctgtgacccaaacccgcagggcagcaggcacgatggacaggcccgtgactgaccacgctgggctccagcctgccagccctggagatcatgaaacagatggccaaggtcaccctacaggtcatccagatctggctccgaggggtctgcatcgctgctgccctcccaacgccagtccaaatgggacagggacggcctcacagcaccatctgctgccatcaggccagcgatcccagaagcccctccctcaaggctgggcacatgtgtggacactgagagccctcatatctgagtaggggcaccaggagggaggggctggccctgtgcactgtccctgcccctgtggtccctggcctgcctggccctgacacctgagcctctcctgggtcatttccaagacagaagacattcctggggacagccggagctgggcgtcgctcatcctgcccggccgtcctgagtcctgctcatttccagacctcaccggggaagccaacagaggactcgcctcccacattcagagacaaagaaccttccagaaatccctgcctctctccccagtggacaccctcttccaggacagtcctcagtggcatcacagcggcctgagatccccaggacgcagcaccgctgtcaataggggccccaaatgcctggaccagggcctgcgtgggaaaggcctctggccacactcgggctttttgtgaagggccctcctgctgtgtgactacagtaactaccatagtgatgaacccagtggcaaaaactggctggaaacccaggggctgtgtgcacgcctcagcttggagctctccaggagcacaagagccgggcccaaggatttgtgcccagaccctcagcctctagggacacctgggtcatctcagcctgggctggtgccctgcacaccatcttcctccaaataggggcttcagagggctctgaggtgacctcactcatgaccacaggtgacctggcccttccctgccagctataccagaccctgtcttgacagatgccccgattccaacagccaattcctgggaccctgaatagctgtagacaccagcctcattccagtacctcctgccaattgcctggattcccatcctggctggaatcaagaaggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagacagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagaggcccgtcccagagcccaggaggctgcagaggcctctccagggagacactgtgcatgtctggtacctaagcagccccccacgtccccagtcctgggggcccctggctcagctgtctgggccctccctgctccctgggaagctcctcctgacagccccgcctccagttccaggtgtggttattgtcaggcgatgtcagactgtggtggatatagtggctacgattaccacagtggtgccgcccatagcagcaaccaggccaagtagacaggcccctgctgcgcagccccaggcatccacttcacctgcttctcctggggctctcaaggctgctgtctgtcctctggccctctgtggggagggttccctcagtgggaggtctgtgctccagggcagggatgattgagatagaaatcaaaggctggcagggaaaggcagcttcccgccctgagaggtgcaggcagcaccacggagccacggagtcacagagccacggagcccccattgtgggcatttgagagtgctgtgcccccggcaggcccagccctgatggggaagcctgtcccatcccacagcccgggtcccacgggcagcgggcacagaagctgccaggttgtcctctatgatcctcatccctccagcagcatcccctccacagtggggaaactgaggcttggagcaccacccggccccctggaaatgaggctgtgagcccagacagtgggcccagagcactgtgagtaccccggcagtacctggctgcagggatcagccagagatgccaaaccctgagtgaccagcctacaggaggatccggccccacccaggccactcgattaatgctcaaccccctgccctggagacctcttccagtaccaccagcagctcagcttctcagggcctcatccctgcaaggaaggtcaagggctgggcctgccagaaacacagcaccctccctagccctggctaagacagggtgggcagacggctgtggacgggacatattgctggggcatttctcactgtcacttctgggtggtagctctgacaaaaacgcagaccctgccaaaatccccactgcctcccgctaggggctggcctggaatcctgctgtcctaggaggctgctgacctccaggatggctccgtccccagttccagggcgagagcagatcccaggcaggctgtaggctgggaggccacccctgcccttgccggggttgaatgcaggtgcccaaggcaggaaatggcatgagcacagggatgaccgggacatgccccaccagagtgcgccccttcctgctctgcaccctgcaccccccaggccagcccacgacgtccaacaactgggcctgggtggcagccccacccagacaggacagacccagcaccctgaggaggtcctgccagggggagctaagagccatgaaggagcaagatatggggcccccgatacaggcacagatgtcagctccatccaggaccacccagcccacaccctgagaggaacgtctgtctccagcctctgcaggtcgggaggcagctgacccctgacttggacccctattccagacaccagacagaggcgcaggccccccagaaccagggttgagggacgccccgtcaaagccagacaaaaccaaggggtgttgagcccagcaagggaaggcccccaaacagaccaggaggtttctgaaggtgtctgtgtcacagtggggtatagcagcagctggtaccacagtgacactcacccagccagaaaccccattccaagtcagcggaagcagagagagcagggaggacacgtttaggatctgagactgcacctgacacccaggccagcagacgtctcccctccagggcaccccaccctgtcctgcatttctgcaagatcaggggcggcctgagggggggtctagggtgaggagatgggtcccctgtacaccaaggaggagttaggcaggtcccgagcactctccccattgaggctgacctgcccagagagtcctgggcccaccccacacaccggggcggaatgtgtgcaggcctcggtctctgtgggtgttccgctagctggggctcacagtgctcaccccacacctaaaatgagccacagcctccggagcccccgcaggagaccccgcccacaagcccagcccccacccaggaggccccagagctcagggcgccccgtcggattccgaacagccccgagtcacagcgggtataaccggaaccaccactgtcagaatagctacgtcaaaaactgtccagtggccactgccggaggccccgccagagagggcagcagccactctgatcccatgtcctgccggctcccatgacccccagcacgcggagccccacagtgtccccactggatgggaggacaagagctggggattccggcgggtcggggcaggggcttgatcgcatccttctgccgtggctccagtgcccctggctggagttgacccttctgacaagtgtcctcagagagacaggcatcaccggcgcctcccaacatcaaccccaggcagcacaggcacaaaccccacatccagagccaactccaggagcagagacaccccaataccctgggggaccccgaccctgatgacttcccactggaattcgccgtagagtccaccaggaccaaagaccctgcctctgcctctgtccctcactcaggacctgctgccgggcgaggccttgggagcagacttgggcttaggggacaccagtgtgaccccgaccttgaccaggacgcagacctttccttcctttcctggggcagcacagactttggggtctgggccaggaggaacttctggcaggtcgccaagcacagaggccacaggctgaggtggccctggaaagacctccaggaggtggccactccccttcctcccagctggaccccatgtcctccccaagataagggtgccatccaaggcaggtgctccttggagccccattcagactcctccctggaccccactgggcctcagtcccagctctggggatgaagccaccacaagcacaccaggcagcccaggcccagccaccctgcagtgcccaagcacacactctggagcagagcagggtgcctctgggaggggctgagctccccaccccacccccacctgcacaccccacccacccctgcccagcggctctgcaggagggtcagagccccacatggggtatggacttagggtctcactcacgtggctcccatcatgagtgaaggggcctcaagcccaggttcccacagcagcgcctgtcgcaagtggaggcagaggcccgagggccaccctgacctggtccctgaggttcctgcagcccaggctgccctgctgtccctgggaggcctgggctccaccagaccacaggtccagggcaccgggtgcaggagccacccacacacagctcacaggaagaagataagctccagacccccagggccagaacctgccttcctgctactgcttcctgccccagacctgggcgccctcccccgtccacttacacacaggccaggaagctgttcccacacagaacaaccccaaaccaggaccgcctggcactcaggtggctgccatttccttctccatttgctcccagcgcctctgtcctccctggttcctccttcgggggaacagcctgtgcagccagtccctgcagcccacaccctggggagacccaaccctgcctggggcccttccaaccctgctgctcttactgcccacccagaaaactctggggtcctgtccctgcagtccctaccctggtctccacccagacccctgtgtatcactccagacacccctcccaggcaaaccctgcacctgcaggccctgtcctcttctgtcgctagagcctcagtttctcccccctgtgcccacaccctacctcctcctgcccacaactctaactcttcttctcctggagcccctgagccatggcattgaccctgccctcccaccacccacagcccatgccctcaccttcctcctggccactccgaccccgccccctctcaggccaagccctggtatttccaggacaaaggctcacccaagtctttcccaggcaggcctgggctcttgccctcacttcccggttacacgggagcctcctgtgcacagaagcagggagctcagcccttccacaggcagaaggcactgaaagaaatcggcctccagcaccttgacacacgtccgcccgtgtctctcactgcccgcacctgcagggaggctccgcactccctctaaagacaagggatccaggcagcagcatcacgggagaatgcagggctcccagacatcccagtcctctcacaggcctctcctgggaagagacctgcagccaccaccaaacagccacagaggctgctggatagtaactgagtcaatgaccgacctggagggcaggggagcagtgagccggagcccataccatagggacagagaccagccgctgacatcccgagctcctcaatggtggccccataacacacctaggaaacataacacacccacagccccacctggaacagggcagagactgctgagcccccagcaccagccccaagaaacaccaggcaacagtatcagagggggctcccgagaaagagaggaggggagatctccttcaccatcaaatgcttcccttgaccaaaaacagggtccacgcaactcccccaggacaaaggaggagccccctatacagcactgggctcagagtcctctctgagacaccctgagtttcagacaacaacccgctggaatgcacagtctcagcaggagaacagaccaaagccagcaaaagggacctcggtgacaccagtagggacaggaggattttgtgggggctcgtgtcactgtgaggatattgtagtggtggtagctgctactcccacagtgacacagacccattcccaaagccctactgcaaacacacccactcctggggctgaggggctgggggagcgtctgggaagtagggtccaggggtgtctatcaatgtccaaaatgcaccagactccccgccaaacaccaccccaccagccagcgagcagggtaaacagaaaatgagaggctctgggaagcttgcacaggccccaaggaaagagctttggcgggtgtgcaagaggggatgcaggcagagcctgagcagggccttttgctgtttctgctttcctgtgcagagagttccataaactggtgttcaagatcagtggctgggaatgagcccaggagggcagtctgtgggaagagcacagggaaggaggagcagccgctatcctacactgtcatctttcaaaagtttgccttgtgaccacactattgcatcatgggatgcttaagagctgatgtagacacagctaaagagagaatcagtgagatgaatttgcagcatagatctgaataaactctccagaatgtggagcagtacagaagcaaacacacagaaagtgcctgatgcaaggacaaagttcagtgggcaccttcaggcattgctgctgggcacagacactctgaaaagccttggcaggatctccctgcgacaaagcagaaccctcaggcaatgccagccccagagccctccctgagagcgtcatggggaaagatgtgcagaacagctgattatcatagactcaaactgagaacagagcaaacgtccatctgaagaacagtcaaataagcaatggtaggttcatgcaatgcaaacccagacagccaggggacaacagtagagggctacaggcggctttgcggttgagttcatgacaatgctgagtaattggagtaacagaggaaagcccaaaaaatacttttaatgtgatttcttctaaataaaatttacaccaggcaaaatgaactgtcttcttaagggataaactttcccctggaaaaactacaaggaaaattaagaaaacgatgatcacataaacacagttgtggttacttctactggggaaggaagagggtatgagctgagacacacagagtcggcaagtctccaagcaagcacagaacgaatacattacagtaccttgaatacagcagttaaacttctaaatcgcaagaacaggaaaatgcacacagctgtgtttagaaaattctcagtccagcactattcataatagcaaagacattaacccaggttggataaataaatgatgacacaggcaattgcacaatgatacagacatacatttagtacatgagacatcgatgatgtatccccaaagaaatgactttaaagagaaaaggcctgatgtgtggtggcactcacctccctgggatccccggacaggttgcaggcacactgtgtggcagggcaggctggtacatgctggcagctcctggggcctgatgtggagcaagcgcagggctgtatacccccaaggatggcacagtcagtgaattccagagagaagcagctcagccacactgcccaggcagagcccgagagggacgcccacgtacagggaggcagagcccagctcctccacagccaccaccacctgtgcacgggccaccaccttgcaggcacagagtgggtgctgagaggaggggcagggacaccaggcagggtgagcacccagagaaaactgcagaagcctcacacatccacctcagcctcccctgacctggacctcacctggtctggacctcacctggcctgggcctcacctgacctggacctcacctggcctgggcttcacctgacctggacctcacctggcctccggcctcacctgcacctgctccaggtcttgctggaacctgagtagcactgaggctgcagaagctcatccagggttggggaatgactctggaactctcccacatctgacctttctgggtggaggcatctggtggccctgggaatataaaaagccccagaatggtgcctgcgtgatttgggggcaatttatgaacccgaaaggacatggccatggggtgggtagggacatagggacagatgccagcctgaggtggagcctcaggacacagttggacgcggacactatccacataagcgagggacagacccgagtgttcctgcagtagacctgagagcgctgggcccacagcctcccctcggtgccctgctgcctcctcaggtcagccctggacatcccgggtttccccaggccagatggtaggtttgaagtgaggtctgtgtcactgtggtattatgattacgtttgggggagttatcgttatacccacagcatcacacggtccatcagaaacccatgccacagccctccccgcaggggaccgccgcgtgccatgttacgattttgatcgaggacacagcgccatgggtatggtggctaccacagcagtgcagcccatgacccaaacacacagggcagcaggcacaatggacaggcctgtgagtgaccatgctgggctccagcccgccagccccggagaccatgaaacagatggccaaggtcaccccacagttcagccagacatggctccgtggggtctgcatcgctgctgccctctaacaccagcccagatggggacaaggccaaccccacattaccatctcctgctgtccacccagtggtcccagaagcccctccctcatggctgagccacatgtgtgaaccctgagagcaccccatgtcagagtaggggcagcagaagggcggggctggccctgtgcactgtccctgcacccatggtccctcgcctgcctggccctgacacctgagcctcttctgagtcatttctaagatagaagacattcccggggacagccggagctgggcgtcgctcatcccgcccggccgtcctgagtcctgcttgtttccagacctcaccagggaagccaacagaggactcacctcacacagtcagagacaaagaaccttccagaaatccctgtctcactccccagtgggcaccttcttccaggacattcctcggtcgcatcacagcaggcacccacatctggatcaggacggcccccagaacacaagatggcccatggggacagccccacaacccaggccttcccagacccctaaaaggcgtcccaccccctgcacctgccccagggctaaaaatccaggaggcttgactcccgcataccctccagccagacatcacctcagccccctcctggaggggacaggagcccgggagggtgagtcagacccacctgccctcgatggcaggcggggaagattcagaaaggcctgagatccccaggacgcagcaccactgtcaatgggggccccagacgcctggaccagggcctgcgtgggaaaggccgctgggcacactcaggggctttttgtgaaggcccctcctactgtgtgactacggtgactaccacagtgatgaaactagcagcaaaaactggccggacacccagggaccatgcacacttctcagcttggagctctccaggaccagaagagtcaggtctgagggtttgtagccagaccctcggcctctagggacaccctggccatcacagcggatgggctggtgccccacatgccatctgctccaaacaggggcttcagagggctctgaggtgacttcactcatgaccacaggtgccctggccccttccccgccagctacaccgaaccctgtcccaacagctgccccagttccaacagccaattcctggggcccagaattgctgtagacaccagcctcgttccagcacctcctgccaattgcctggattcacatcctggctggaatcaagagggcagcatccgccaggctcccaacaggcaggactcccgcacaccctcctctgagaggccgctgtgttccgcagggccaggccctggacagttcccctcacctgccactagagaaacacctgccattgtcgtccccacctggaaaagaccactcgtggagcccccagccccaggtacagctgtagagagactccccgagggatctaagaaggagccatgcgcagttctgccgggaccctcggccaggccgacaggagtggacactggagctgggcccacactgggccacataggagctcaccagtgagggcaggagagcacatgccggggagcacccagcctcctgctgaccagaggcccgtcccagagcccaggaggctgcagaggcctctccagggggacactgtgcatgtctggtccctgagcagccccccacgtccccagtcctgggggcccctggcacagctgtctggaccctccctgttccctgggaagctcctcctgacagccccgcctccagttccaggtgtggttattgtcagggggtgtcagactgtggtggatacagctatggttaccacagtggtgctgcccatagcagcaaccaggccaagtagacaggcccctgctgtgcagccccaggcctccacttcacctgcttctcctggggctctcaaggtcactgttgtctgtactctgccctctgtggggagggttccctcagtgggaggtctgttctcaacatcccagggcctcatgtctgcacggaaggccaatggatgggcaacctcacatgccgcggctaagatagggtgggcagcctggcgggggacagtacatactgctggggtgtctgtcactgtgcctagtggggcactggctcccaaacaacgcagtcctcgccaaaatccccacagcctcccctgctaggggctggcctgatctcctgcagtcctaggaggctgctgacctccagaatgtctccgtccccagttccagggcgagagcagatcccaggccggctgcagactgggaggccaccccctccttcccagggttcactggaggtgaccaaggtaggaaatggccttaacacagggatgactgcgccatcccccaacagagtcagccccctcctgctctgtaccccgcaccccccaggccagtccacgaaaaccagggccccacatcagagtcactgcctggcccggccctggggcggacccctcagcccccaccctgtctagaggacttggggggacaggacacaggccctctccttatggttcccccacctgcctccggccgggacccttggggtgtggacagaaaggacacctgcctaattggcccccaggaacccagaacttctctccagggaccccagcccgagcacccccttacccaggacccagccctgcccctcctcccctctgctctcctctcatcaccccatgggaatccggtatccccaggaagccatcaggaagggctgaaggaggaagcggggccgtgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcgggtgctcctccatcttcggtgagcctcccccttcacccaccgtcccgcccacctcctctccaccctggctgcacgtcttccacaccatcctgagtcctacctacaccagagccagcaaagccagtgcagacaaaggctggggtgcaggggggctgccagggcagcttcggggagggaaggatggagggaggggaggtcagtgaagaggcccccttcccctgggtccaggatcctcctctgggacccccggatcccatcccctcctggctctgggaggagaagcaggatgggagaatctgtgcgggaccctctcacagtggaatatccccacagcggctcaggccagacccaaaagcccctcagtgagccctccactgcagtcctgggcctgggtagcagcccctcccacagaggacagacccagcaccccgaagaagtcctgccagggggagctcagagccatgaaagagcaggatatggggtccccgatacaggcacagacctcagctccatccaggcccaccgggacccaccatgggaggaacacctgtctccgggttgtgaggtagctggcctctgtctcggaccccactccagacaccagacagaggggcaggccccccaaaaccagggttgagggatgatccgtcaaggcagacaagaccaaggggcactgaccccagcaagggaaggctcccaaacagacgaggaggtttctgaagctgtctgtatcacagtggggtatagcagtggctggtaccacagtgacactcgccaggccagaaaccccgtcccaagtcagcggaagcagagagagcagggaggacacgtttaggatctgaggccgcacctgacacccagggcagcagacgtctcccctccagggcaccctccaccgtcctgcgtttcttcaagaataggggcggcctgagggggtccagggccaggcgataggtcccctctaccccaaggaggagccaggcaggacccgagcaccgtccccattgaggctgacctgcccagacgggcctgggcccaccccacacaccggggcggaatgtgtgcaggccccagtctctgtgggtgttccgctagctggggcccccagtgctcaccccacacctaaagcgagccccagcctccagagccccctaagcattccccgcccagcagcccagcccctgcccccacccaggaggccccagagctcagggcgcctggtcggattctgaacagccccgagtcacagtgggtataactggaacgaccaccgtgagaaaaactgtgtccaaaactgactcctggcagcagtcggaggccccgccagagaggggagcagccggcctgaacccatgtcctgccggttcccatgacccccagcacccagagccccacggtgtccccgttggataatgaggacaagggctgggggctccggtggtttgcggcagggacttgatcacatccttctgctgtggccccattgcctctggctggagttgacccttctgacaagtgtcctcagaaagacagggatcaccggcacctcccaatatcaaccccaggcagcacagacacaaaccccacatccagagccaactccaggagcagagacaccccaacactctgggggaccccaaccgtgataactccccactggaatccgccccagagtctaccaggaccaaaggccctgccctgtctctgtccctcactcagggcctcctgcagggcgagcgcttgggagcagactcggtcttaggggacaccactgtgggccccaactttgatgaggccactgacccttccttcctttcctggggcagcacagactttggggtctgggcagggaagaactactggctggtggccaatcacagagcccccaggccgaggtggccccaagaaggccctcaggaggtggccactccacttcctcccagctggaccccaggtcctccccaagataggggtgccatccaaggcaggtcctccatggagcccccttcagactcctcccgggaccccactggacctcagtccctgctctgggaatgcagccaccacaagcacaccaggaagcccaggcccagccaccctgcagtgggcaagcccacactctggagcagagcagggtgcgtctgggaggggctaacctccccaccccccaccccccatctgcacacagccacctaccactgcccagaccctctgcaggagggccaagccaccatggggtatggacttagggtctcactcacgtgcctcccctcctgggagaaggggcctcatgcccagatccctgcagcactagacacagctggaggcagtggccccagggccaccctgacctggcatctaaggctgctccagcccagacagcactgccgttcctgggaagcctgggctccaccagaccacaggtccagggcacagcccacaggagccacccacacacagctcacaggaagaagataagctccagaccccagggcgggacctgccttcctgccaccacttacacacaggccagggagctgttcccacacagatcaaccccaaaccgggactgcctggcactagggtcactgccatttccctctccattccctcccagtgcctctgtgctccctccttctggggaacaccctgtgcagcccctccctgcagcccacacgctggggagaccccaccctgcctcgggccttttctacctgctgcacttgccgcccacccaaacaaccctgggtacgtgaccctgcagtcctcaccctgatctgcaaccagacccctgtccctccctctaaacacccctcccaggccaactctgcacctgcaggccctccgctcttctgccacaagagcctcaggttttcctacctgtgcccaccccctaacccctcctgcccacaacttgagttcttcctctcctggagcccttgagccatggcactgaccctacactcccacccacacactgcccatgccatcaccttcctcctggacactctgaccccgctcccctccctctcagacccggccctggtatttccaggacaaaggctcacccaagtcttccccatgcaggcccttgccctcactgcctggttacacgggagcctcctgtgcgcagaagcagggagctcagctcttccacaggcagaaggcactgaaagaaatcagcctccagtgccttgacacacgtccgcctgtgtctctcactgcctgcacctgcagggaggctccgcactccctctaaagatgagggatccaggcagcaacatcacgggagaatgcagggctcccagacagcccagccctctcgcaggcctctcctgggaagagacctgcagccaccactgaacagccacggaggtcgctggatagtaaccgagtcagtgaccgacctggagggcaggggagcagtgaaccggagcccataccatagggacagagaccagccgctaacatcccgagcccctcactggcggccccagaacaccccgtggaaagagaacagacccacagtcccacctggaacagggcagacactgctgagcccccagcaccagccccaagaaacactaggcaacagcatcagagggggctcctgagaaagagaggaggggaggtctccttcaccatcaaatgcttcccttgaccaaaaacagggtccacgcaactcccccaggacaaaggaggagccccctgtacagcactgggctcagagtcctctctgagacaggctcagtttcagacaacaacccgctggaatgcacagtctcagcaggagagccaggccagagccagcaagaggagactcggtgacaccagtctcctgtagggacaggaggattttgtgggggttcgtgtcactgtgagcatattgtggtggtgactgctattcccacagtgacacaaccccattcctaaagccctactgcaaacgcacccactcctgggactgaggggctgggggagcgtctgggaagtatggcctaggggtgtccatcaatgcccaaaatgcaccagactctccccaagacatcaccccaccagccagtgagcagagtaaacagaaaatgagaagcagctgggaagcttgcacaggccccaaggaaagagctttggcaggtgtgcaagaggggatgtgggcagagcctcagcagggccttttgctgtttctgctttcctgtgcagagagttccataaactggtattcaagatcaatggctgggagtgagcccaggaggacagtgtgggaagagcacagggaaggaggagcagccgctatcctacactgtcatcttttgaaagtttgccctgtgcccacaatgctgcatcatgggatgcttaacagctgatgtagacacagctaaagagagaatcagtgaaatgcatttgcagcacagatctgaataaatcctccagaatgtggagcagcacagaagcaagcacacagaaagtgcctgatgccaaggcaaagttcagtgggcaccttcaggcattgctgctgggcacagacactctgaaaagcactggcaggaactgcctgtgacaaagcagaaccctcaggcaatgccagccctagagcccttcctgagaacctcatgggcaaagatgtgcagaacagctgtttgtcatagccccaaactatggggctggacaaagcaaacgtccatctgaaggagaacagacaaataaacgatggcaggttcatgaaatgcaaactaggacagccagaggacaacagtagagagctacaggcggctttgcggttgagttcatgacaatgctgagtaattggagtaacagaggaaagcccaaaaaatacttttaatgtgatttcttctaaataaaatttacacccggcaaaatgaactatcttcttaagggataaactttcccctggaaaaactataaggaaaatcaagaaaacgatgatcacataaacacagtggtggttacttctactggggaaggaagagggtatgagctgagacacacagagtcggcaagtctcctaacaagaacagaacaaatacattacagtaccttgaaaacagcagttaaacttctaaatcgcaagaagaggaaaatgcacacacctgtgtttagaaaattctcagtccagcactgttcataatagcaaagacattaacccaggttggataaataagcgatgacacaggcaattgcacaatgatacagacatacattcagtatatgagacatcgatgatgtatccccaaagaaatgactttaaagagaaaaggcctgatgtgtggtggcaatcacctccctgggcatccccggacaggctgcaggctcactgtgtggcagggcaggcaggcacctgctggcagctcctggggcctgatgtggagcaggcacagagctgtatatccccaaggaaggtacagtcagtgcattccagagagaagcaactcagccacactccctggccagaacccaagatgcacacccatgcacagggaggcagagcccagcacctccgcagccaccaccacctgcgcacgggccaccaccttgcaggcacagagtgggtgctgagaggaggggcagggacaccaggcagggtgagcacccagagaaaactgcagaagcctcacacatccacctcagcctcccctgacctggacctcacctggcctgggcctcacctgacctggacctcacctggcctgggcttcacctggcctgggcttcacctgacctggacctcacctggcctcgggcctcacctggcctgggcttcacctggcctgggcttcacctgacctggacctcacctggcctgggcctcacctgacctggacctcacctggcctgggcttcacctggcctgggcttcacctggcctgggcttcacctgacctggacctcacctggcctgggcttcacctgacctggacctcacctggcctcgggcctcacctgcacctgctccaggtcttgctggagcctgagtagcactgaggctgtagggactcatccagggttggggaatgactctgcaactctcccacatctgacctttctgggtggaggcacctggtggcccagggaatataaaaagccccagaatgatgcctgtgtgatttgggggcaatttatgaacccgaaaggacatggccatggggtgggtagggacagtagggacagatgtcagcctgaggtgaagcctcaggacacaggtgggcatggacagtgtccacctaagcgagggacagacccgagtgtccctgcagtagacctgagagcgctgggcccacagcctcccctcggggccctgctgcctcctcaggtcagccctggacatcccgggtttccccaggcctggcggtaggtttgaagtgaggtctgtgtcactgtggtattactatgatagtagtggttattactaccacagtgtcacagagtccatcaaaaactcatgcctgggagcctcccaccacagccctccctgcgggggaccgctgcatgccgtgttaggattttgatcgaggacacggcgccatgggtatggtggctaccacagcagtgcagcccatgacccaaacacacggggcagcagaaacaatggacaggcccacaagtgaccatgatgggctccagcccaccagccccagagaccatgaaacagatggccaaggtcaccctacaggtcatccagatctggctccaaggggtctgcatcgctgctgccctcccaacgccaaaccagatggagacagggccggccccatagcaccatctgctgccgtccacccagcagtcccggaagcccctccctgaacgctgggccacgtgtgtgaaccctgcgagccccccatgtcagagtaggggcagcaggagggcggggctggccctgtgcactgtcactgcccctgtggtccctggcctgcctggccctgacacctgagcctctcctgggtcatttccaagacattcccagggacagccggagctgggagtcgctcatcctgcctggctgtcctgagtcctgctcatttccagacctcaccagggaagccaacagaggactcacctcacacagtcagagacaacgaaccttccagaaatccctgtttctctccccagtgagagaaaccctcttccagggtttctcttctctcccaccctcttccaggacagtcctcagcagcatcacagcgggaacgcacatctggatcaggacggcccccagaacacgcgatggcccatggggacagcccagcccttcccagacccctaaaaggtatccccaccttgcacctgccccagggctcaaactccaggaggcctgactcctgcacaccctcctgccagatatcacctcagccccctcctggaggggacaggagcccgggagggtgagtcagacccacctgccctcaatggcaggcggggaagattcagaaaggcctgagatccccaggacgcagcaccactgtcaatgggggccccagacgcctggaccagggcctgtgtgggaaaggcctctggccacactcaggggctttttgtgaagggccctcctgctgtgtgactacggtggtaactcccacagtgatgaaaccagcagcaaaaactgaccggactcgcagggtttatgcacacttctcggctcggagctctccaggagcacaagagccaggcccgagggtttgtgcccagaccctcggcctctagggacacccgggccatcttagccgatgggctgatgccctgcacaccgtgtgctgccaaacaggggcttcagagggctctgaggtgacttcactcatgaccacaggtgccctggtcccttcactgccagctgcaccagaccctgttccgagagatgccccagttccaaaagccaattcctggggccgggaattactgtagacaccagcctcattccagtacctcctgccaattgcctggattcccatcctggctggaatcaagagggcagcatccgccaggctcccaacaggcaggactcccacacaccctcctctgagaggccgctgtgttccgcagggccaggccgcagacagttcccctcacctgcccatgtagaaacacctgccattgtcgtccccacctggcaaagaccacttgtggagcccccagccccaggtacagctgtagagagagtcctcgaggcccctaagaaggagccatgcccagttctgccgggaccctcggccaggccgacaggagtggacgctggagctgggcccacactgggccacataggagctcaccagtgagggcaggagagcacatgccggggagcacccagcctcctgctgaccagagacccgtcccagagcccaggaggctgcagaggcctctccagggggacacagtgcatgtctggtccctgagcagcccccaggctctctagcactgggggcccctggcacagctgtctggaccctccctgttccctgggaagctcctcctgacagccccgcctccagttccaggtgtggttattgtcagggggtgccaggccgtggtagagatggctacaattaccacagtggtgccgcccatagcagcaaccaggccaagtagacagacccctgccacgcagccccaggcctccagctcacctgcttctcctggggctctcaaggctgctgtctgccctctggccctctgtggggagggttccctcagtgggaggtctgtgctccagggcagggatgactgagatagaaatcaaaggctggcagggaaaggcagcttcccgccctgagaggtgcaggcagcaccacagagccatggagtcacagagccacggagcccccagtgtgggcgtgtgagggtgctgggctcccggcaggcccagccctgatggggaagcctgccccgtcccacagcccaggtccccaggggcagcaggcacagaagctgccaagctgtgctctacgatcctcatccctccagcagcatccactccacagtggggaaactgagccttggagaaccacccagccccctggaaacaaggcggggagcccagacagtgggcccagagcactgtgtgtatcctggcactaggtgcagggaccacccggagatccccatcactgagtggccagcctgcagaaggacccaaccccaaccaggccgcttgattaagctccatccccctgtcctgggaacctcttcccagcgccaccaacagctcggcttcccaggccctcatccctccaaggaaggccaaaggctgggcctgccaggggcacagtaccctcccttgccctggctaagacagggtgggcagacggctgcagataggacatattgctggggcatcttgctctgtgactactgggtactggctctcaacgcagaccctaccaaaatccccactgcctcccctgctaggggctggcctggtctcctcctgctgtcctaggaggctgctgacctccaggatggcttctgtccccagttctagggccagagcagatcccaggcaggctgtaggctgggaggccacccctgtccttgccgaggttcagtgcaggcacccaggacaggaaatggcctgaacacagggatgactgtgccatgccctacctaagtccgcccctttctactctgcaacccccactccccaggtcagcccatgacgaccaacaacccaacaccagagtcactgcctggccctgccctggggaggacccctcagcccccaccctgtctagaggagttggggggacaggacacaggctctctccttatggttcccccacctggctcctgccgggacccttggggtgtggacagaaaggacgcctgcctaattggcccccaggaacccagaacttctctccagggaccccagcccgagcacccccttacccaggacccagccctgcccctcctcccctctgctctcctctcatcactccatgggaatccagaatccccaggaagccatcaggaagggctgaaggaggaagcggggccgctgcaccaccgggcaggaggctccgtcttcgtgaacccagggaagtgccagcctcctagagggtatggtccaccctgcctggggctcccaccgtggcaggctgcggggaaggaccagggacggtgtgggggagggctcagggccctgcaggtgctccatcttggatgagcccatccctctcacccaccgacccgcccacctcctctccaccctggccacacgtcgtccacaccatcctgagtcccacctacaccagagccagcagagccagtgcagacagaggctggggtgcaggggggccgccagggcagctttggggagggaggaatggaggaaggggaggtcagtgaagaggcccccctcccctgggtctaggatccacctttgggacccccggatcccatcccctccaggctctgggaggagaagcaggatgggagattctgtgcaggaccctctcacagtggaatacctccacagcggctcaggccagatacaaaagcccctcagtgagccctccactgcagtgcagggcctgggggcagcccctcccacagaggacagacccagcaccccgaagaagtcctgccagggggagctcagagccatgaaggagcaagatatggggaccccaatactggcacagacctcagctccatccaggcccaccaggacccaccatgggtggaacacctgtctccggcccctgctggctgtgaggcagctggcctctgtctcggacccccattccagacaccagacagagggacaggccccccagaaccagtgttgagggacacccctgtccagggcagccaagtccaagaggcgcgctgagcccagcaagggaaggcccccaaacaaaccaggaggtttctgaagctgtctgtgtcacagtcgggtatagcagcggctaccacaatgacactgggcaggacagaaaccccatcccaagtcagccgaaggcagagagagcaggcaggacacatttaggatctgaggccacacctgacactcaagccaacagatgtctcccctccagggcgccctgccctgttcagtgttcctgagaaaacaggggcagcctgaggggatccagggccaggagatgggtcccctctaccccgaggaggagccaggcgggaatcccagccccctccccattgaggccatcctgcccagaggggcccggacccaccccacacacccaggcagaatgtgtgcaggcctcaggctctgtgggtgccgctagctggggctgccagtcctcaccccacacctaaggtgagccacagccgccagagcctccacaggagaccccacccagcagcccagcccctacccaggaggccccagagctcagggcgcctgggtggattctgaacagccccgagtcacggtgggtatagtgggagctactaccactgtgagaaaagctatgtccaaaactgtctcccggccactgctggaggcccagccagagaagggaccagccgcccgaacatacgaccttcccagacctcatgacccccagcacttggagctccacagtgtccccattggatggtgaggatgggggccggggccatctgcacctcccaacatcacccccaggcagcacaggcacaaaccccaaatccagagccgacaccaggaacacagacaccccaataccctgggggaccctggccctggtgacttcccactgggatccacccccgtgtccacctggatcaaagaccccaccgctgtctctgtccctcactcagggcctgctgaggggcgggtgctttggagcagactcaggtttaggggccaccattgtggggcccaacctcgaccaggacacagatttttctttcctgccctggggcaacacagactttggggtctgtgcagggaggaccttctggaaagtcaccaagcacagagccctgactgaggtggtctcaggaagacccccaggagggggcttgtgccccttcctctcatgtggaccccatgccccccaagataggggcatcatgcagggcaggtcctccatgcagccaccactaggcaactccctggcgccggtccccactgcgcctccatcccggctctggggatgcagccaccatggccacaccaggcagcccgggtccagcaaccctgcagtgcccaagcccttggcaggattcccagaggctggagcccacccctcctcatccccccacacctgcacacacacacctaccccctgcccagtccccctccaggagggttggagccgcccatagggtgggggctccaggtctcactcactcgcttcccttcctgggcaaaggagcctcgtgccccggtcccccctgacggcgctgggcacaggtgtgggtactgggccccagggctcctccagccccagctgccctgctctccctgggaggcctgggcaccaccagaccaccagtccagggcacagccccagggagccgcccactgccagctcacaggaagaagataagcttcagaccctcagggccgggagctgccttcctgccaccccttcctgccccagacctccatgccctcccccaaccacttacacacaagccagggagctgtttccacacagttcaaccccaaaccaggacggcctggcactcgggtcactgccatttctgtctgcattcgctcccagcgcccctgtgttccctccctcctccctccttcctttcttcctgcattgggttcatgccgcagagtgccaggtgcaggtcagccctgagcttggggtcacctcctcactgaaggcagcctcagggtgcccaggggcaggcagggtgggggtgaggcttccagctccaaccgctccactagccgagactaaggaagtgagaggcagccagaaatccagaccattccatagcaaatggatttcattaaagttaccagacttcagtgtaagtaacatgagccccatgcacaacaatcccttatgaaggggaagtcagtgtcgcctcggatttcttgaaaaacacaaaaacttatcaatgcctgtaaaagtctgttggaaagaaaatatgattcaagaatgttatgcccaacaaagctggcatattttctacccggacacactcagggaatgtggtcccttgagtgcttctctcactgcgtaaatcctacgtggtgtttaagcatattcataaatgtgtatgtctatttttatgtgtaagatggttcatttttattttatttattcaatatgtacaataaagaatattgacaaataggctggacatggtggctcccacctgtaatcccagccctttgggaggccgaggcgggcagatcacctgaggtctggagttcgagaccagcctggccaacatgatgaaaacccatctctactaaaaatacaaagattagccaggcatggtggtgcatgcctgtaatcccagccactcaggaggctgagacaggagaaatgcgtgaacccggaaggcggaggttgcagtgagccgagatcacaccactgcactccagcctggcgacagagcaagattccatctcaaaaaaaaaaaaagacaaagaaatttgtttttttgaataaagacaaatttcatcacacgaagataaagatgcaaagctccagacaggaaggcacggacagcacagtgaagcccggagcgggcgctggggggccaggggcatggcgggggtgccagcgtctctcggttcctaccatggccactccagcctgtgttctcacgaggatggctgtgcaatgctaggagcgtgttcgaagctctagggcaaccactggaagtgaggctgaggagcagagcccagaggcccgtggagctgatgaaaagaaagctggagaaagtgtttgctgcctcccaacatggtaagaaaagatagaaagagagagcacacggcaaagggagcttgctgagggactctttacaatggcttgcacagagctcagggggtctgggaggctagggccctgcgcagggcagtcaccccagcctgctgaccaaggtttgctgcaggcagctctgggggtggttgaggcgcggtccctggagccacccctcaagggaacgaggcagcagagtgggccaaggcccaggtcggctgcaaggctgcccaggacttggggtccttacatcagcagccactgatgcagctggcccagagagaggcgccgagcaggttgcctccaggggacaaaccaggtcggagagggtgaggcagtggatggagccacaacaaccccgggcacgggtgacacgcacgttcatgcacatctgacccttcctccctcaccaaacaggtccccctgccttccccatggttgcgaaaaagcaaaatgtagacgttttttcttttttaattcatgttttaattgacaaatgaagccgtatatatttattgtgtacaacatgatgctttaaaatatgtatacatcgtggaacagcaacgttgagctaatttaacacgcattacttcacatacttgtcatcttttgtggcgagaatgcttaaaatccactctcttagtattttttaagaatgcaatacattgttgtcaactgtggtcaccgtcatgcatagccaagctcccgacctcaccctcctgccagctcaggctgtgcatcctttcaccagcatcccccaccccggcccctggccctggtaactaccactctatactctacgtatgagttcagctttttaagattccacagatgaatgagatcatacagtatttgctttctatgcctggcttattttagttaacacactgtcctccagatccatccgttgttgcaaatgacagggtttcattctttttaaagtctaaagagtattccattgtgtcaatggacctcatttgctttatccatgcatcaactatggacatttaggttgattccatttcttagctgttgtggatggtgctgcagtaaacatggggctgcagatgtctcttcaacatactgacatcatgtcctttggataaatacccagtagtgggatcgctggatcacaatgtacagttttttttttaatggaaactttcattttttggtgaaattaggaaaacagataaaacccacagaatccaaaatatatgtgaagatgccaaaaacagttgacattgggcagaggtcacatggaaggaagtgaatacatgacggggtgtgagggcccagaggcagctgaaatacgctttctaaacacaaggacctcttctgagagggcagaagttttatcctgcacatgcaatgaccagcacagctaaaatacactttctaaacatgaggacctcttctgagagggcagctttatcctgcaaatgcaatgaccagcacaggacccagaataaagagagttgccagcggacgcctggtgtccatgtgtccaggtgagttcgagatgcggacggcgctggccagccagtcacaccctaagtcaatctgctgcatgcatttgtccttgccacagcagaaaacgagaaagcctttgggctgcaaagcttcacaggctcctcttctcccgactccatggaaacagctacaaagagcaggcccagtagagcttaattcatgaaaatgagtaataaacttgaactggaacagtatcgactttttagaaacggcagcaaagtgtataaaaaatattcaccagaacaatatttccaaacgatgagatgagaatttcagccaagtaatcctccatggatagaaaataatgaagggattggatttatgaaggaaaatcatggagctcaaatacaagaaaagagaatcaaaaatgaacaggaggagataaaatatggtttggccaaagttacaaaataaattttttaaaaacccttcatcatggcaagtagaaagagcgagaggaaaaacagatcccgtggaagacacaaataggacatggggagaaaaatgaatgagatgaaacagagcagaaataaaattttacggaactaaagacaagtgatctgaacctgcctggggcctgggggacctcgccaccctgaagggaaagaacatgcctggctggctttgccacctgctcattgcagagccccacagcttgcaacaaacataggcggtagccagggagtggttacagcaggccttgagcaagacccagtgttgtgctgacttcaggtctgacccagcactgtcatagtggtggtgtccatagtggtagtgggggtgcttgtgtcactccacccccatctccaggaggctcagaacagacagagagagactccatttgtttgggagaaagtaagggatgagaacaagagtctctgcctggtaatccagagaattattctagatcttggccaagattatcaaagcagtacctctatgagtcttttgggcttggagtccccctaaagcagatatagctaagatcacaacacccaagtccttttgaatatgtgggaagacttcccaaggacaggagcaaacaaacaagcccagactgcaaaaaaacaagccgagactgcaataaacacctcactcttcaatgcccaggcactgaagaacatctcctagcagcaacaccatccaggaaaacatggcctcaaccagtgaactaaataaggcaccagggaccagtctcggagaaatagaggtatgttatctttcagagaattcaaagtagctttgttgaggaaactcaaagaaattcaagataacacagtgaaggaattcagaatcctatccgataaatttaacagagattgaagcaattaaaaagaattaagcagaaattatggagctgaaaaatgcaattggcatactgaaaaatgcatcagagtattttcatagcctcatatatcaagtagaagaaagaattagtgagcttgaaaacaggctatttggaaaagcacgataaaaggagacaaaagagaaaagaataaataacaatgaagcatatctacaggatctagaaaatagcctcaaaaggccaaatctaagaattattagccttaaagaggaggtagagaaagagggatggagagtttattcaaagggataataacagaaaacttcccaaacctagagaaagatatcaatatccaaatgcaagaaggatgtagtacaccaaggagatttaatgcaaagaagactacctcaaggcattcaatactcaaactcccatatgacaaggactttaaaaagatcctaaaagcagcaaaagaaaagaaatgaataaaatactatggagctccaatatgtctggcagcagacttttcagtgaagactttatatgccaggagagagtgtcataatggatttaaagtgctgaaggaaaaaacttttaccctcgaacagtatagctggtgaaattatccttcaaacatgaaggagaaataatttgtttccagacaaatgttgagggatttcatgaacaccagacctgtcttttaagaaatgctaaagggagtacttcaatcagaaagaaacacgttagtgaacaataagaaatcatctgaaggcacaaaactcaccggtaatagtaagtacacagaaaaacacagaatattataacactgtaactgtggtgtgtaaactccttttgtttgtttgtttgtttgtttgtttgtttttgtttttagacggagttttgctccagcccaggctggagtgcaatggcacaatctcagctcactgcaacttccacctcccgggttcaagcaattctcctgcctcagcctcccaagtagctgggattacaggcatgtgctaccatgtccagctaattttgtattttagtagagacggtgtttcaccatgttggtcaggctagccttatcttgagtagaaaaactaaatgatgaagcaatgaaaaataataactacaacttttcaagacatagtacaataagatataaatcataacaaaaagttaaaaggtggagggatgaagttaaggcatagagtctttattagttttctttttacttgtctgtttatgcaaacagtgttaagttgtcatcagtttaaaataatgggtcataagatactatttgcaagcctcatggtaacgtcaaaccaaaagcaatacaacagatacacaaaaaacaaaaagcaagaagctaaattacgtcatcagagaaaatcaccttcactaaaaggaagacggagaaaagaatgaagagagagaagaccaaaagcaaatagcaatatggcaggagtaagtccttacttatcaataataccattgaatgtaaatggactaaactctccaatcaaaagacatagagtggctgaatcaattaaagaaaaaacaagacccattgatctgttgtccacaagaaacacactttatctataaagacacacatagactgaaaacaaagggatggaaaaagatactccacgccaatggaaaccaaagaaagagcaggagtagctacacttatatcaggcaaaatagatttcaagacaaaaactataagaagagacaaggtcactaatgataaacaggtcaattcagcaagaggatataacaattgtaaatatatatgcacccaatgctggagcacccagatatataaagcaagtatttactagagctaaagagagaaatagactccaatgcaataatagctggagatttcaacatcccactttcaacattgaacagatcctccagatagaaaatcaacaaagaaatattggacttaatctgcactatcgaccaaatggatctaacagatatttacagaacatttcatccaacagctgcagaacacacattcttttcctcagcacatagatcattctcaaggatagaccatatgttgggtcacaaaacaagttttaaaatattcaaatacattgaaataatatcaagcatcttctgtgaccacaatggactaaaactagaaatcaataacaagaggaattttggaaactatataaatatatggaaattaatgaatgctgagtgggtcaatgaagcaattaagaaggaaactgaaatttttcttggaacgaatgatcatggaaacagaaaataccaaaacctatgggatacagcaaaagcagtactaagagggaagtttacagctacaaatgcttacattaaaaaagaagaaaaacttcaataaaaaaacctaacaatgcatcttaaagaactagaaaagcaagaggaaatcaaatccaaaattagtagaagaaaacagtaaaggtcagagcagaaataagtaaaattgaaatgaagaaaacaatacaaaagatcaataaaacaacaggttgttttcttgaaaagttaaacaaaattgacaaacctttagccagactaagaaaaaaagacagaagatccaaataaataaaatcagagatgaaaaaggtgacattacaacttacaccacagaaattcaaaggatcattagtggctactataagcaactatatgccaataaattggaaaatctagaagaaatgcagaaattcctagacacatacaacctcccaagattaaaccaagaagaaattcaaaacctgaacagactgataacaagtaatgagatcaaagccgtaataaaaagcctcccagtaaagagaagcccaggacccgacggcttcactgctgaattctaccaaacatttaaagtagaactaataccaatcctactcaaactattccaaaaaatagaggtggaaggaatacttcaaaactcattatacgaggccagtattaacctgacaccaaaactagacaaagacacatgaaaaaaagaaaactacaggccaatatgtctgatgaatattgacacaaaaatcctcaacaaaatactagcaaaccaaattcaactacacattagaaagttcactcatcatgaccaagtggaatttatctaacttgggatgcaaagatggttcaacatatgcaaatcaatcaatgtgatacatcatatcaacagaatgaacaacaaaaaccatttgatcatttaattgatactgaaaaagcatttgataaaattcaacattccttcataataaaaattctcttctatactaggtacaaaagaaacttacctcaacataataaagccatatatgacagtcccacagtatgatactaaatgaggaaaaactgagagcctttcctctacgatctggaacatgacaaagatgcccactttcatcactgttattcaacatagtactggaagtcctagctggagcgatcagacaagagaaagatataaaagacatccaaattggaaaggaataagtcaaattatcctcatttgcatatggtatgatcttctatttagagctaactaaagactccaccaaaaaaagttattagaactgacgaacaaattcagtaaagctgcaggatacaaaatcaacatacaaaaatcagtagcatttctatatgccaacaatgaccaatgtgaaaaagaaattaaaaagtaaccctatttacaataaccacaaataaacacctaggaattaaccaaagaggtaaaagatttctgtaatgaaaactataaaacactgatgaaagaaattgaagagtacaccaaaaaatggaaagcaattgcatgttcatggattagaagaatcagtgttgttataatgtccatactatccaaagcaatctacagattcaatgcaatccttatcaaaataccaatgacatcattcacagaaatagaaaaaaaaaatcctaaaatttacgtggaaccacaaagacccagaatagccaaagctctcctaagcaaaaagaacgaaactgtaggaatgacattgcctgtcttcaaattctactacagagctatagatagtaaccaaaacagcgtggtactggcataaaaacagacacagagacaaacagaacaaaatttaaaaacccagaaataaatccacacacctacagcaaattcatttttgacaaagttgccaagaacatactctggggaatagataatgatatctcttcaataaatagtgtggggaaaactggatatccatatacataacagtgaaactagacccctctctctctcactatatacaaaaatcaaatcaaaattgtttaaggacttaaatctaagacctcatactatgaaaccactgcaagacaaccttggcggaaactctccaagacatcagtccaggcaaagatttcttgagtaatatcccacaagcacagacaaccaaagcaaaaatggacaaatgggatcacatcaagttaaaaagcttctgcacagtaagggaaacaaccaacaaaatgaagagacaacccacagaatgggagaaaatatttgaaaaatacccatctggcaagggattaaaaaccagaatatatgcagaatatataaggagctcaaacagtgctatagaaaaaaaaatctaataatctgatttaaaaatgggaaaaatgttagaatagacatttcttaaaataagacatacagatggcaaaccgacatggaacggtgctcaacatcatggattatcacagaaacacaatcaatcaaaactaaaactaaaatgtgctatcatctcaccccagttaaaatggctgatatccagaagacaggcaataacaaatgctggcaaggatgtggggaaaagggagcccccatacactgttgctgggattgtaaattagtacaaccactgtggagagcagcatgaaagttcctcaaaaaactgaaagaaagctaccataggatccagcaatcccactgctgtgtatatactacaaaagaaaggaagtcagtatatgaagaggtatctgcactcccatgtttgttgcagccctgttcacaacagccaagatttggaagcaacctaagtgtccatcagcagttgaatgtataaagaaaatgtggtgcatatacacaatggagtattattcaataataaaaaggaatgagattgagtcatttgcaacaacatggatggaactggagatcattatgtgaagtgaaataagccaggcacagaaagacaaacattacaatgttcttacttattaatgagatctaaaaatcaaaacaattgcacccatgttcataaagagtaaaaggatggttaccagatgctgagaacggtggtggggggatagggaaaggtggcagtggttaacgggtacaaaaaaatagaaagaatgaataagacttgctacttgatagcacagcaaggtggctatagtcagtaatttagttgtatatttttaataatgaaaggtgtataattggattgtttctaacacaaaggataatgcttaagaggatggataccccattttccatgatgtgattatttcacattgcacgcctagatcaaaacatccaatgtaccccataaatatatacatcttctatgtacccataaaaattctgtaaaataaaatatataaaaagaggtgacagatatggaagacaggcaaagaagagacgacatccacataatccgagtacctaagaaagaatggagtccagtgcatctcaggagccaccattctaagccaattttctctggttctctcagtcaccctaccaatacgtgggcaatcttgttttatttcaggatagagtttttgaaattatagatttaagtatgctttctgttctattacttttggtaattaattttagaaagaactaatttgggcacaaatttgaaaaaattctaaatccaaaaaaaaaaagaaaaaaacacacacacaatcatctataagggggatgatgaccagtcctagatttctcaccagccacattcaagatcagtaaatggtaggacaaaacctgtagggtccttaagggggaaagaagtagtggatagtccagagtctatatacagccaactgttcttgaagaaaaaaggctgctgaaaaggagttccaaacattctataatccataatctcatgatgaaactactagaggaagaccaccagccatcaaaaggtgcttggagaacccagggccaagaaccaaaagtaaatattaagtgtccttaactgcgagactaagatagaaatgactgtgggggaccatgtggcctcaacagaggtgaaatggtgtctgcctgacaaagtggacattttacaatgatcaaaacacagaatatgagatagagagcacttctgaattactgcctcactccaaataactctcagccaaaggacttcagtaaaaccaaattgggcatattagacagtacaaacaaattctaagaaaataatattactgattacaatcacatgatgctagagatggaggggaaaaggaagaggaaaccaggtaatttcatactcgtatatagtaaagaactaaagtacattgtccaaagaagaacaaagaatattttggaaagttataaaggtagccactacacatagaagatagcaaagaacaagaaaacttaagatggaaaactttttggaagcataagaatagaaaatataaactactaagataagattgaagccaaacagatctatgaaaacaacaaacatcaatggccttaacttgcctattaaaaggaagagactttcaaattggaccacaagataaaacccaactctatatagcatatgagtattacacacaaaatgggaaaagctgaaaaaacttgggcaaaattcaccccaagcaaattccactgtttcctttgggacaaaatgccaagctccatgccagggaagatgattctcctcagaccttctcctcactctcccagtcctcttagggaaggaattgggtgttagaggagggagactctgtcgattatcagctgaagcagtggtgtgctcctgcgttgcttctgacctgggaaatgaagcagcaagactctttctgctgtgtctttgcccagaagggccatccccccagagcagagtacccaggccggcaggagcagtggtggaagcgtggaaaccacgtctcctacagcagagaccatcagaagcggagcctcgggtataagggaaacaacgcgttctccctaacctgggagtgacagacagcgtcattcctcacagtgataccctgtgttctagccatctggcccatgacagagccagcccagagccagcccagagccagcccctcaccatcctggagcctggccagctcgccaagctgcaccataggcctggaaggcgtggagacctgcggcagtgccctgtcctcccgtgaggcctgccatccctgccaggggtcgcctctggcttctccttctccaggaccgcacggtccagaggctcagtgcctggagtaggtgttgcctccctgcttctaggcccagaccctcccttgttcctgaccccgggcctttccctctggcttggacatccagggccctgtctcagctggggagctgctcctgctcaaggactgtcttccgcgggatcgaaaggccgcgtcctgaacaatgcgtgggccacgtaagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgtgagcggagcaggctctaaaggccgcgtcctaaacagtgcgtgggccacgggagcggagcagactctaaaggccgcgtcctaaacagtgtgtgggccacgtgagcggagcgccctctccactgccctcggggccgcagctcccagctcagctcccagccctgctcagggcagccaggccaggaggtaccatccaggctaagtgaccctcaggggggacaggtgccccaggagatgccagctgttgggagaggctgggggaccaactcgacctggcctgtgggccctgccctggccacccattgtaggatccagccgccacgcctgtgacactcgtgtgctttccctggtgtgtgcttgtggcaggtgggggcagagggtcctcaggccagagagccactcccccagcgccagaccaccctcttcctcactcccccacctcaccccctcacaggtgcctcccaggccatcagggcccaaccacccctaaacaaatgggttctcggcccctcgtggctggaggtgggttctctcaccattcccagcctaagactccatccccatgctggcagctgttcaaccatgtctagagagatccactgtcccagacagcacctcagggtcccccgtcctgcctggaaccctgtaggaaactccacaaaccgccgccattctgtccacacccctacaggagccccaaccctctccccacatccaggcttccctcccagacccctcatccctgcccgcacggtgcctgagggggccttcttgggcagcgcctaagcaagcccccagcacccttcggccccttcaaggcacacaggccccctttccacccagcctcaggaaaccacctgtgtcctccaacgacaggtcccagcctcccagcctttgccttgcctgttcctctccctggaactctgccccgacacagaccctccccagcaagcccgcaggggcacctcccctgcccccagacaccctgtgcccgtcagttcatccccagcagaggccctcaccaggcacacccccatgctcacacctggccccaggcctcagcctccctgagggccccacccagcccgcgtctggccagtggtgcgtgcaaagcccctcacccagactcggcggaaggcagccagtgcaggcctggggaggggctctccttagaccaccttgcaccttccctggcacccaccatgggaagagctgagactcactgaggaccagctgaggctcagagaagggacccagcactggtggacacgcagggagcccacgccagggcgccgtggtgagtgaggcccagtgccacccactgaggcctcccgttcagtgggacgacggtgaacaggtggaaccaaccaggcaacccccgccgggccccacagacgggatcagagcaggaaaggcttcctgcccctgcaggccagcgaggagccctggcgggggccgtggccctccaggcgaggaggctcccctggccaccgccacccgggcctctctgctgctgggaaaacaagtcagaaagcaagtggatgagaggtggcgtgacagacccagcttcagatctgctctaatttacaaaagaaaaggaaaaacacacttggcagccttcagcactctaatgattcttaacagcagcaaattattggcacaagactccagagtgactggcagggttgagggctggggtctcccacgtgttttggggctaacagcggaagggagagcactggcaaaggtgctgggggcccctggacccgacccgccctggagaccgcagccacatcagcccccagccccacaggccccctaccagccgcagggttttggctgagctgagaaccactgtgctaactggggacacagtgattggcagctctacaaaaaccatgctcccccgggaccccgggctgtgggtttctgtagcccctggctcagggctgactcaccgtggctgaatacttccagcactggggccagggcaccctggtcaccgtctcctcaggtgagtctgctgtctggggatagcggggagccaggtgtactgggccaggcaagggctttggcttcagacttggggacaggtgctcagcaaaggaggtcggcaggagggcggagggtgtgtttttgtatgggagaagcaggagggcagaggctgtgctactggtacttcgatctctggggccgtggcaccctggtcactgtctcctcaggtgagtcccactgcagccccctcccagtcttctctgtccaggcaccaggccaggtatctggggtctgcagccggcctgggtctggcctgaggccacaccagctgccatccctggggtctccgccatgggctgcatgccagagccctgctgtcacttagccctggggccagctggagcccccaaggacaggcagggaccccgctgggcttcagccccgtcagggaccctccacaggtagcaagcaggccgagggcagggacgggaaggagaagttgtgggcagagcctgggctggggctgggcgctggctgttcatgtgccggggaccaggcctgcgctttagtgtggctacaagtgcttggagcactggggccagggcagcccggccaccgtctccctgggaacgtcacccctccctgcctgggtctcagcccgggggtctgtgtggctggggacagggacgccggctgcctctgctctgtgcttgggccatgtgacccattcgagtgtcctgcacgggcacaggtttgtgtctgggcaggaacagggactgtgtccctgtgtgatgcttttgatatctggggccaagggacaatggtcaccgtctcttcaggtaagatggctttccttctgcctcctttctctgggcccagcgtcctctgtcctggagctgggagataatgtccgggggctccttggtctgcgctgggccatgtggggccctccggggctccttctccggctgtttgggaccacgttcagcagaaggcctttctttgggaactgggactctgctgctggggcaaagggtgggcagagtcatgcttgtgctggggacaaaatgaccttgggacacggggctggctgccacggccggcccgggacagtcggagagtcaggtttttgtgcaccccttaatggggcctcccacaatgtgactactttgactactggggccagggaaccctggtcaccgtctcctcaggtgagtcctcacaacctctctcctgctttaactctgaagggttttgctgcatttttggggggaaataagggtgctgggtctcctgccaagagagccccggagcagcctggggggctcaggaggatgccctgaggcaacagcggccacacagacgaggggcaagggctccagatgctccttcctcctgagcccagcagcacgggtctctctgtggccagggccaccctaggcctctggggtccaatgcccaacaacccccgggccctccccgggctcagtctgagagggtcccagggacgtagcggggcgccagttcttgcctggggtcctggcattgttgtcacaatgtgacaactggttcgacccctggggccagggaaccctggtcaccgtctcctcaggtgagtcctcaccaccccctctctgagtccacttagggagactcagcttgccagggtctcagggtcagagtcttggaggcattttggaggtcaggaaagaaagccggggagagggacccttcgaatgggaacccagcctgtcctccccaagtccggccacagatgtcggcagctggggggctccttcggctggtctggggtgacctctctccgcttcacctggagcattctcaggggctgtcgtgatgattgcgtggtgggactctgtcccgctccaaggcacccgctctctgggacgggtgccccccggggtttttggactcctgggggtgacttagcagccgtctgcttgcagttggacttcccaggccgacagtggtctggcttctgaggggtcaggccagaatgtggggtacgtgggaggccagcagagggttccatgagaagggcaggacagggccacggacagtcagcttccatgtgacgcccggagacagaaggtctctgggtggctgggtttttgtggggtgaggatggacattctgccattgtgattactactactactacggtatggacgtctggggccaagggaccacggtcaccgtctcctcaggtaagaatggccactctagggcctttgttttctgctactgcctgtggggtttcctgagcattgcaggttggtcctcggggcatgttccgaggggacctgggcggactggccaggaggggacgggcactggggtgccttgaggatctgggagcctctgtggattttccgatgcctttggaaaatgggactcaggttgggtgcgtctgatggagtaactgagcctctagactgagcattgcagactaatcttggatatttgtccctgagggagccggctgagagaagttgggaaataaactgtctagggatctcagagcctttaggacagattatctccacatctttgaaaaactaagaatctgtgtgatggtgttggtggagtccctggatgatgggatagggactttggaggctcatttgagggagatgctaaaacaatcctatggctggagggatagttggggctgtagttggagattttcagtttttagaataaaagtattagctgcggaatatacttcaggaccacctctgtgacagcatttatacagtatccgatgcatagggacaaagagtggagtggggcactttctttagatttgtgaggaatgttccacactagattgtttaaaacttcatttgttggaaggagagctgtcttagtgattgagtcaagggagaaaggcatctagcctcggtctcaaaagggtagttgctgtctagagaggtctggtggagcctgcaaaagtccagctttcaaaggaacacagaagtatgtgtatggaatattagaagatgttgcttttactcttaagttggttcctaggaaaaatagttaaatactgtgactttaaaatgtgagagggttttcaagtactcatttttttaaatgtccaaaattcttgtcaatcagtttgaggtcttgtttgtgtagaactgatattacttaaagtttaaccgaggaatgggagtgaggctctctcataacctattcagaactgacttttaacaataataaattaagtttcaaatatttttaaatgaattgagcaatgttgagttggagtcaagatggccgatcagaaccagaacacctgcagcagctggcaggaagcaggtcatgtggcaaggctatttggggaagggaaaataaaaccactaggtaaacttgtagctgtggtttgaagaagtggttttgaaacactctgtccagccccaccaaaccgaaagtccaggctgagcaaaacaccacctgggtaatttgcatttctaaaataagttgaggattcagccgaaactggagaggtcctcttttaacttattgagttcaaccttttaattttagcttgagtagttctagtttccccaaacttaagtttatcgacttctaaaatgtatttagaattcattttcaaaattaggttatgtaagaaattgaaggactttagtgtctttaatttctaatatatttagaaaacttcttaaaattactctattattcttccctctgattattggtctccattcaattcttttccaatacccgaagcatttacagtgactttgttcatgatcttttttagttgtttgttttgccttactattaagactttgacattctggtcaaaacggcttcacaaatctttttcaagaccactttctgagtattcattttaggagaaagactttttttttaaatgaatgcaattatctagacttatttcagttgaacatgctggttggtggttgagaggacactcagtcagtcagtgacgtgaagggcttctaagccagtccacatgctctgtgtgaactccctctggccctgcttattgttgaatgggccaaaggtctgagaccaggctgctgctgggtaggcctggactttgggtctcccacccagacctgggaatgtatggttgtggcttctgccacccatccacctggctgctcatggaccagccagcctcggtggctttgaaggaacaattccacacaaagactctggacctctccgaaaccaggcaccgcaaatggtaagccagaggcagccacagctgtggctgctgctcttaaagcttgtaaactgtttctgcttaagagggactgagtcttcagtcattgctttagggggagaaagagacatttgtgtgtcttttgagtaccgttgtctgggtcactcacatttaactttccttgaaaaactagtaaaagaaaaatgttgcctgttaaccaataatcatagagctcatggtactttgaggaaatcttagaaagcgtgtatacaattgtctggaattatttcagttaagtgtattagttgaggtactgatgctgtctctacttcagttatacatgtgggtttgaattttgaatctattctggctcttcttaagcagaaaatttagataaaatggatacctcagtggtttttaatggtgggtttaatatagaaggaatttaaattggaagctaatttagaatcagtaaggagggacccaggctaagaaggcaatcctgggattctggaagaaaagatgtttttagtttttatagaaaacactactacattcttgatctacaactcaatgtggtttaatgaatttgaagttgccagtaaatgtacttcctggttgttaaagaatggtatcaaaggacagtgcttagatccgaggtgagtgtgagaggacaggggctggggtatggatacgcagaaggaaggccacagctgtacagaattgagaaagaatagagacctgcagttgaggccagcaggtcggctggactaactctccagccacagtaatgacccagacagagaaagccagactcataaagcttgctgagcaaaattaagggaacaaggttgagagccctagtaagcgaggctctaaaaagcacagctgagctgagatgggtgggcttctctgagtgcttctaaaatgcgctaaactgaggtgattactctgaggtaagcaaagctgggcttgagccaaaatgaagtagactgtaatgaactggaatgagctgggccgctaagctaaactaggctggcttaaccgagatgagccaaactggaatgaacttcattaatctaggttgaatagagctaaactctactgcctacactggactgttctgagctgagatgagctggggtgagctcagctatgctacgctgtgttggggtgagctgatctgaaatgagatactctggagtagctgagatggggtgagatggggtgagctgagctgggctgagctagactgagctgagctagggtgagctgagctgggtgagctgagctaagctggggtgagctgagctgagcttggctgagctagggtgagctgggctgagctggggtgagctgagctgagctggggtaagctgggatgagctggggtgagctgagctgagctggagtgagctgagctgggctgagctggggtgagctgggctgagctgggctgagctgggctgagctggggtgagctgagctggggtgagctgagctgagctggggtgagctgagctgagctggggtgagctggggtgagctgagctggggtgagctgagctgagctggggtgagctgagctggggtgagctgagctgagctggggtgagctgagctgagctgagctgagctgagctggggtgagctgagctgagctgagctggggtgagctggggtgagctgagctgagctggagtgagctgagctgggctgagctggggtgagctgggctgagctggggtgagctgagctgagctgagctgagctggggtgagctgagctgagctggggtgagctgagctggggtgagctgggctgagctgagctgagctgagctgagctgagctgagctgagctgagctgagctgagctgagctgagctgagctgagctgagctgagctggggtgagctgagctgagctgggctgagctggggtgagctgggctgagctgggctgagctgggctgagctggggtgagctgagctggggtgagctgagctgagctgggctgagctgagctgagctggggtgagctgagctgagctggggtgagctgagctgagctgagctggggtgagctgagctgagctgggctgagcagggctgagctggggtgagctgagctgagctggggtgagctgggctgagctgggctgagctgagctgagctgggctgagctgggctgagctgggctgagctgggctgagctgggctgagctggggtgagctgagctggggtgagctggggtgagctgagctggggtgagctgagctggggtgagctgagctgagctggggtgagctgagctggggtgagctgagctgagctggggtgagctgagctgagctggggtgagctgagctagggtgaactgggctgggtgagctggagtgagctgagctgaggtgaactggggtgagccgggatgttttgagttgagctggggtaagatgagctgaactggggtaaactgggatgagctgtggtgagcggagctggattgaactgagctgtgtgagctgagctggggtcagctgagcaagagtgagtagagctggctggccagaaccagaatcaattaggctaagtgagccagattgtgctgggatcagctgtactcagatgagctgggatgaggtaggctgggatgagctgggctagctgacatggattatgtgaggctgagctagcatgggctggcctagctgatgagctaagcttgaatgagcggggctgagctggactcagatgtgctagactgagctgtactggatgatctggtgtagggtgatctggactcaactgggctggctgatgggatgcgccaggttgaactaggctcagataagttaggctgagtagggcctggttgagatggttcgggatgagctgggaaaagatggactcggaccatgaactgggctgagctgggttgggagaccatgaattgagctgaactgagtgcagctgggataaactgggttgagctaagaatagactacctgaattgtgccaaactcggctgggatcaattggaaattatcaggatttagatgagccggactaaactatgctgagctggactggttggatgtgttgaactggcctgctgctgggctggcatagctgagttgaacttaaatgaggaaggctgagcaaggctagcctgcttgcatagagctgaactttagcctagcctgagctggaccagcctgagctgagtaggtctaaactgagttaaaaatcaacagggataatttaacagctaatttaacaagcctgaggtctgagattgaatgagcagagctgggatgaactgaatgagtttcaccaggcctggaccagttaggctaggacctcgttctatagaggcagactgtgtgctacagtggagtttcaagatgattccatgagtcctccccgcccccaacataacccaccttcctcctaccctacacgcctgtctggtgtgtaaatcccagctttgtgtgctgatacagaagcctgagcccctcccccacctccacctacctattactttgggatgagaatagttctcccagccagtgtctcagagggaagccaagcaggacaggcccaaggctacttgagaagccaggatctaggcctctccctgagaacgggtgttcatgcccctagagttggctgaagggccagatccacctactctagaggcatctctccctgtctgtgaaggcttccaaagtcacgttcctgtggctagaaggcagctccatagccctgctgcagtttcgtcctgtataccaggttcacctactaccatatctagccctgcctgccttaagagtagcaacaaggaaatagcagggtgtagagggatctcctgtctgacaggaggcaagaagacagattcttacccctccatttctcttttatccctctctggtcctcagagagtcagtccttcccaaatgtcttccccctcgtctcctgcgagagccccctgtctgataagaatctggtggccatgggctgcctggcccgggacttcctgcccagcaccatttccttcacctggaactaccagaacaacactgaagtcatccagggtatcagaaccttcccaacactgaggacagggggcaagtacctagccacctcgcaggtgttgctgtctcccaagagcatccttgaaggttcagatgaatacctggtatgcaaaatccactacggaggcaaaaacaaagatctgcatgtgcccattccaggtaagaaccaaaccctcccagcaggggtgcccaggcccaggcatggcccagagggagcagcggggtggggcttaggccaagctgagctcacaccttgacctttcattccagctgtcgcagagatgaaccccaatgtaaatgtgttcgtcccaccacgggatggcttctctggccctgcaccacgcaagtctaaactcatctgcgaggccacgaacttcactccaaaaccgatcacagtatcctggctaaaggatgggaagctcgtggaatctggcttcaccacagatccggtgaccatcgagaacaaaggatccacaccccaaacctacaaggtcataagcacacttaccatctctgaaatcgactggctgaacctgaatgtgtacacctgccgtgtggatcacaggggtctcaccttcttgaagaacgtgtcctccacatgtgctgccagtgagtggcctgggctaagcccaatgcctagccctcccagattagggaagtcctcctacaattatggccaatgccacccagacatggtcatttgctccttgaactttggctccccagagtggccaaggacaagaatgagcaataggcagtagaggggtgagaatcagctggaaggaccagcatcttcccttaagtaggtttgggggatggagactaagcttttttccaacttcacaactagatatgtcataacctgacacagtgttctcttgactgcaggtccctccacagacatcctaaccttcaccatccccccctcctttgccgacatcttcctcagcaagtccgctaacctgacctgtctggtctcaaacctggcaacctatgaaaccctgaatatctcctgggcttctcaaagtggtgaaccactggaaaccaaaattaaaatcatggaaagccctcccaatggcaccttcagtgctaagggtgtggctagtgtttgtgtggaagactggaataacaggaaggaatttgtgcgtactgtgactcacagggatctgccttcaccacagaagaaattcatctcaaaacccaatggtaggtatccccccttcccttcccctccaattgcaggacccttcctgtacctcatagggagggcaggtcctcttccaccctatcctcactactgtcttcatttacagaggtgcacaaacatccacctgctgtgtacctgctgccaccagctcgtgagcaactgaacctgagggagtcagccacagtcacctgcctggtgaagggcttctctcctgcagacatcagtgtgcagtggcttcagagagggcaactcttgccccaagagaagtatgtgaccagtgccccgatgccagagcctggggccccaggcttctactttacccacagcatcctgactgtgacagaggaggaatggaactccggagagacctatacctgtgttgtaggccacgaggccctgccacacctggtgaccgagaggaccgtggacaagtccactggtaaacccacactgtacaatgtctccctgatcatgtctgacacaggcggcacctgctattgaccatgctagcgctcaaccaggcaggccctgggtgtccagttgctctgtgtatgcaaactaaccatgtcagagtgagatgttgcattttataaaaattagaaataaaaaaaatccattcaaacgtcactggttttgattatacaatgctcatgcctgctgagacagttgtgttttgcttgctctgcacacaccctgcatacttgcctccaccctggcccttcctctaccttgccagtttcctccttgtgtgtgaactcagtcaggcttacaacagacagagtatgaacatgcgattcctccagctacttctagatatatggctgaaagcttgcatgcctgcaggtcgactctagaggatccccgggtaccgagctcgaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgaaccccttgc

SEQ ID NO: 77 - DNA, 17728 bp, Artificial Sequence
  Description of Artificial Sequence: Synthetic polynucleotide
taactataacggtcctaaggtagcgagggatgacagattctctgttcagtgcactcagggtctgcctccacgagaatcaccatgtcctttctcaagactgtgttctgtgcagtgccctgtcagtggaaatctggagagcatgcttccatgagcttgtgagtagtatatctagtaagccatggctttgtgttaatggtgatgttctacatatcagttctctggcttaataatgaggtgatgattctatgttcctgtaacgcttcctcaactgggtcctaagtctttcttcactccatctattcctctaaggaatgatcctgaaaatcccatcacaaactataggagatgggaaccatcaaaaaacacagtgacaaagaggtgggaacgcatcagggttcaggaaccatattttaaaaagatatcgtaaataacttcttaaaagagatatagacaaatctccattaatacggagaccagaggcctaaggctaagaaccaatggtggctcaaggtctcctgctacccgaggagcaaacgtagagcagtttctaatgatttatttaaaatatagaatcaaaagtaccagtttgcaattttgaaagatttatttcagcaatgcaacaacatcaggtggtgccgagtccaacacgtcttatgtcccatgatataaacaaaggccatccagaactgtggactggagttctaccttgtcccctaatgacattcagattttttttccattctctttatcttagaggagacagggggctaactcattttacttgtcctttgcttgttcttgccaagaacgtaaagcagcttgcaagtcttcaaacctaaatatcttagtaactcctacacgagtggcaatgccaaagagcagtgcaacaaagaggaagtaaatacgaccaaagagtattcttaaatacactactggctctaggttctgttttattatgcgcctttgaaccggaggggacccactgtctatgctcccactgtgtccctcttctttgcactttggagggctccaaccaaaatggcaatggcaattccgacgattgttacacactcctctgaaattgcatttttctggggtgcagtcataacccaaacgagataaacttccattgcaagctcctcgatcacagaacttaccccttgaacacggggtaccatgtctcaccaatccagcatctgctgtttctgtcccacgatgttcatcaagcccaaagcaggtaaccccagagataaccgattgatggaatgaaacatgttcttgcaaaaatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccctcttctgagcatggtgtcccatcttgcagataagtgtcatctgggcaaatgaacttagagccactacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcattgttatctactttgaagtttccacaaaacttataagtcaatgatgtattataataaacatgacggtcatagaaaagacatggcatcagatcaggagtattaagtatgttgcttatctctgcaagggaacaattgctgaaagcatctgttaattgaggatttttgaacatgatgcaggtgttccttctctggcagatacagtacccctcatcatgttttaggcctaaactccttccaacacgattggttattataatagataaaaataaaggatttcgaccatgttgaccaagacaaattagggctgagggagaacatatactcctctcagctggattaacagcatcatctcctggcgaattcttgttaattatagctcctgcatcaggcctaaaatgagcataaaatactctctcatagaaagtatgagcctgccctcctggaactcgaaaatcttgtgaaaatggatcagcctcggtatacacagtcatgagaaagacatagtaccgcatatgaagattggtcagataggtgtccattaaactaatgactttaaacaaatactcaacagtagatgaaagtttgtcacctccagaagcactatatacagaatgggttgcttgaaagtggccttttatagcagctggatgtgtagcgtaattcttactagatagtctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggttatccaactttatgacccctgacaggcccccataacaagtatccacagtgaccatggattgcaggatcccctccaggtagccaatatagtaacaatctacaggaaaaaaggggtactccatctgtaaggctccttggtcatcttgagttgtcagcaacaagtgtctgggccaaatgagtgtctttctccgcaggtggatgatatgtctctggccccgaaaacgcaagctatacgagagcagtctttgtgcttgaagtcctttggtatggtagatctccttccgaggaataaccacctccgatgagatgtaacgccaagtgggatggccttgagaacaccagactggaaccaggaggagcagccagagtgcaaatagcaagaggaggaccctggggaccacaggtctttccactagcctcatgccccaggtcagagataacatcctgggtggagctaactccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttttcacagttgttctaacttcttgttttgttttgtttgtttgtttgtttgaaagttagaagtaaatactgtctatattagccttttagctataaatgattgtttttatttcttctaatcatgttttgtttgagttttggttaaactatttacaaatgagttttttttttccttttgggtgttgctcgaaagtttggagctttctgttaatattgtgttgttgtttctccaatattattagacctgagaattctacctgggtacctgtgaactccagaatttttaaaaattccatctcttgggaacattatctctgaccccgtctgaggccgaagtggctgtccccctccaacctttagtatctttctttcctgactattgggatttcttcaagcaatcaggctgatgggttctcagcagtgagaccagtagactgtcggtatgaacgtcgaagagtctgccacacactccgggttcatcaacagtgctttcgcgtctcttacttttgtagaaggaaatgcagcctctgagttttctccaagaaatcattgatgaaagggtgaaaagatgggtatcacccggagttcatgacaagccctggctcagacacgtgagcaaggtctacagccccaaagataggctgccctgcaacatgtatttataagataggagaaaaaaatgggtagttggagggttgatcaacttacttcctctcaaacatatatatctcatctaagtgtgcaggggaaaactctgtagaactactgggatacctgctcacccccaggagcctcatgaataagtctctgcttctgccttgtagccatgagcattactgcacctgatacccctgcagcttcctagggaagagggaggaagtgacttggcccctgtctggttaaggtaagaggagataaatcccttctcattgattagggtgagaggggtcatgtgctctatcattggtgacccagttgggacatgggtttataccaaagtcatcactctgaggttctgtgtaccaccaggctgaactcccatatcctacatggacataggacaacaccaagcagaaggaggttttaggactaaactgaaggacagagatgcggtttctaaacaactagggagtgccagggccagcctctctaaccactataggacactgtggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaagggagggagggagagagagagaaggctaagtctttccatacctgggtcccaatacctcttataacccaagcacatggtttcacatatcacaatgcggttgggatatagataactgtaaatacttgtgaaaataatggggctgagatctggggttttcatgatagtttcaaagtcaccgtactgactaaaaccttccactggcccatctccagcttcctaatctgagggtatcaaatttcccactaagtgtgtttagaaagatctccacctttttgcccttgtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaaaggtaggcatgtagaagctgaagcatctcacctcattccaagcaccctcagtctctaaatgtgcccccttgtttccagaagtgcaacctcaagcatcttttattcattcatcttagagggccacatgtgctgtagtgttataagatgaaatttaaagcattaattattcctaacaagccaattaaacaagccaaaaacattcatcagtcattcccatggaacctctgaagcatcttcctgctctaaccttgggttttccagggctgctctgggatcacaggagctgtcctgtctaccagccatataaaggcagacctatcagaattacaccagacttctcaccatagactataaaagccagaatatcctggacagatgttatacagaaactaagagaacacaaatgccagcccaggctactatacccagcaaaactctcaattaccatcgatgaagaaaccaagatattccattacaagtccaaatttacacaatatctttccataaatccagccctacaaaggatagcagatggaaaactccaacacaggtaggaaaactacaccctagaaagagcactaaagtaatcatctttcaacacactcaaaagaagataaccacacaaacataattccacctctaacaacaaaaataaagtaggcaacaatcactattccttaatatctcttttaacatcaatggactcaattctccaataaaaagacatagactaacagactgaatacataaacaggacacagcattttgctgcataaagcaaacacagcgttacttttttttttctaaatgacattttttattagatattgtctttattgacatttcaaatgttatcccctttcctggtttaccctctgaaatcccctatctcctccccctccccctgctcaccaatccacccactcccacttccaggccctggcaatcccctatatttgggcatagagccttcacaggaccaaggtactctccttgcattgatgaccaactagtccattctctgctacaaatgcagctagatctatgagtcccaccatgttttcttttgttggtggtttcatgccagggagctcttggagtactgattggttcatattgttgttctccctatggggttacaaaacccttcaacttcttgggtcctttctctggctgcctcattggggaccttgtgcgaagtccaatggatgactgtgagcatccacttctgtatttgccaggcactggcagagcctctcagaagacagctatatcaagatcctggcagcaagctcttgttggtatccacaaaagtgtctggtggttgtctatgggatggatccccaaaggggcagtctctggatggtcattccttcagtctctgttccacactttgtctctttaactccttccatgactattttattcctccctctaagaaggaccgaagtattcatactttggtcttccttcttgaaattcatgtgttttgtgaattgtatctttgatattccgaacttctgggctaatatccacttatcagtgagtgaatatcatgtgtgttcttatgtgattgagttacctcactcaggatgatatcctccagaaccatccatttgtctaagaatttaatgaattcattgtttttaatagctgaggagtactccattgtgtaaatgtaccacattttctgtacccattgttctcttgagggacatctgggttctttaaagcttctggacattaaatataaggctgctatggaaatagtggagaatgtgtccttattacatgttggagcatcttctgggtatatgcccaggagtgctattgctggatcctctgatagtactatgtccaattttctgaggaactgccaaactgatttacagagtggttgtaccagcttgcaattccaccagcaatggagaaatgttccccttcctccacatcctcaccaacatctgctgtcacctcaatttgttcttagtgattcagacaggtgtgaggtggaatatcagggttgtttggcatttccctgatgactagtgatattgaaaaaaattttaagtgtttctcagccattcagtattcttcagttgagaattcgctgtttagctctgtactcaggtttttttaatagggttatttggttttctggagtctaacgtcttgaattctttctatatattggatattagccctctgtcatatttaggattggtaaagatctttcccaatatgttggctgcctttttgtcttattgagagtgtcctttgccttacagaacctttttaattttatgaggtcccatttgctagttcttcattttacagcacaagccattggtgttctgttcaaaaatctttccccctgaaccctatcttcgaggatcttccccactttctcctctataagtttcagtgtctctattattgtgctgagggcgatcgcgatgtgggaacgcttcagtgttcaggaaccatatgatttatttaaaatatagaatcaaaagtaccaatttgcagttttgaaagatttattccagtgtaagcattagcaatgcaccaacatcaggtgatttctgaatccaacacgtcttatgtcctcatgatattaaaaaaaaaaaaggccatccagaactgtgaacttgagttctaccttgttccctactgacattcagattttcttttttgcattctctttatcttacaggagacaggaggggagggctaactcattttactttggcttgtcccttgctggtccttgcccagaacgtaaagtagcttgcaagtcttcaaatctaaaaatcttagtaactcctacacgagtggcaatgccaaagagcagtgcaacaaagaggaagtaaatacgaccaaagagtattcttaaatacaccactggctcttgtttttgttttattgtgtgcctttgaactggaggggacccactgtctatgctcccacttagtccctcttctttgcactctggaggcttccaaccaaaatgacaatggcaattccgatgattgttacacactcctctaaaactgcatttttctggggtgcagtcataacccaaatgagataaacttccactgcaagctccttgatcacagaacttacttttggagcagggggtaccatgtctcaccattccagcatctgttgtttctgtcccacgatgttcatcaagcccaaagcaggtaaacccagagataatcgattgatggaatgaaacatgttcttgcaaatatggaagattggtgacattggtacactgcaaccttccacacagcttgtcctgatcagcacaagcattgaatgtgaggctttcttctgctctagtacaatgcccaaatcgaaaccgttgtttgttgatgtcatagcacttaatattagcattcttagcacttacaccaaagatttccatgcattgtatgttgcgatcagtgcagttacctttatagcagtaaccatcttctgagcatggtgtcccatcttgcagataagtgtcatctgggcaaatgtatttagtcccattacagtactctggaagatcacatatgttctggataggtctgcagagtgtcccagaaggactgtaagtgcaatttgcacagcataattctttatcacaaatgctaccaggtgttaacctgcaatcatttccacagcagggatctgaataacatgccttttgggagccacagtcacactgctcatcgttatctactttgaagtttccacaaaacttataagtcaatgatgtattataataaacatgacggtcatagaaaagacatggcatcagaccaggagtattaagtatgttgcttatctctgcaagggaacaattgctgaaagcatctgttaattgaggatgtctgaacataatgcaggtgttccttctctggcagacacagtacccctcatcatattttaagcctaaactccttccaacacgattggttattataggagataaaaataaaggatttcgatcatatttaccaatacaaattagggctaaggaagaacatatactcctctcagctggattaacctggttatcttgtggcccatacttattaagtaaaactcctgcatcaggcttaaatttattataaaagactgacacatagtaattataagccgaccctcctggaactgcaaactcaagtcgaaatggatcagaattggtgtacacagtcatgagaaagacatagtaccgcatatgaagattggtcagataggtgtccattaaactaatgacttgaaacaaatacccaacagtagatgaaagtttgtcacctgcagcagaattatatacagaattggttgcttgaaagtggccttttatagcagctggatgtgtagcgtagttcttactagatattctgggagctccatctgcatattccaatctggaggagggagaacctgtattatggctccagtgcttccatgcattcataggccctgtgtcatcagactcagatactatctgagaaacaaggtgttcaaagctctgtgaatcattgaggggtttgatttcataggtaaggtcatctaacttcatgacccctgacaggcccccataacaagtatccacagtgaccatggattgtgggatcccctccaggtagccaatatagtaacaatctacaggaaaaaaggggtaatccatctgtaaggctccttggtcatcttgagttgtcagcaacaagtgtctgggccaaatgagtgtctttctccgcaggtggatgatatgtctctggccccgaaaatgcaagctatatgagagcagtctttgtgcttgaagtcctttggtatggtagatctccttccgaggaataaccacctccgatgagatgtaacgccaagtaggatggccttgagaacaccagactggaaccaggaggagcagccagagtgcaaatagcaagaggaggaccctggggaccacaggtctttccactagcctcatgccccaggtcagagataacatcctgggtggagctaaatccctctgctgtggccactgcctggtctagaaaatactgacagaggactaaaaacctcctcaggctcccaacctaagtggttacccagacaactggagttaggtaacagtcactgggtgtggcaggaattgagtctgaatgtgttagctgaggttgaggttaaatattgtcaaaagggatgtctataaatgtgcctggacaagaaaagtcagaagcagcaaggagtgtctctgacaggctcaatcctttcttttctttttttgaagttcaaaatatcatttccacgtgaatgtatttggttcccagtgtgactctgggtctctttctaggagtcaatatttctttatatcttggctcatgtttctcacagttgttctaatttcttgttttgttttgtttgtttgtttgaacgttagtagtaaatactgtctatattagccttttagctataaatgattgtttttatttcttctaatcatattttgtttgagttttggttaaactatttacaaatgagttttttttttttccttttgggtgttgctcgaaagtttggagctttctgttaatattgtgttgttatttttccaatattattagacctgagaattctatctgggtacctgtgaactctagaatttttaaaaattccatctcttgggaacattacctctgaccccgtctgaggccgaagtggctgtccccctccaacctttagtatctttctttcctgactattgggatttcttcaagcaatcaggctgatgggttctcagcagtgagaccagtagactgccggtatgaacgtcgaagagactgccacacactccaggttcatcaacagtgctttcgcgtctcttacttttgtagaaggaaaagcagcctctgagttatctccaagaaatcattaatgaaagagttaaaagatgggtatcacccggagttcatgacaagccctggctcagacacgtgagcaaggtctacagccccaaagataggctgccctgcaacatgtatttataagatagaagaaaaaaatgggtggttggagggttgatcaacttacttcctctcaaacatatatatctcatctaagtgtgcaggggaaaactctgtaggactactgggattgttattatcattattattattattattattattattattattattattattattaacttaaggcattttattagatattttcttcatttagttttcaaatgttatccccggaacctcctatactctctccctgccctgctccccaacccacccactcctacatcctggccctggcattcccctatactgtggcagatgatcttcgtaagaccaagagcctttcctcccattgatggcctactaggctatcctcttttacatatgcaactagagtcacagctctggggaggtattgcttagttcatattgtttttcctcctatagggttgcagatccctttagctccttgggtactttctctagctcctccattgggggccctgtgttccatccaatagatgactgtgagcatccacttctgtatttgccaggtattggcatggatcttactgcaccttctgaactctctaagcagctttcctggtcacctccaggagcctcatgaataagtctctgcttcccccttgtggctatgagcattactgcacctgatacaccctgcagcttcctagggaagagggaggaagtggcttggcccctgtctggttaaggtaagaggagataaatcccttctcatgaattagggtgagaagggtcatgtgctctatcattggtgaccaacttggggacatgggcttatacagtcatcactctgaggctctgtgtaccaccagactgaactcccatatcctacatgcacataggacaacaccaagtagaaggaggttttaggactaaactgaaggacagagatggggtttctaaacaactagggagtgccagggccagcctctctaaccactataggacactatggagtctggttacaaagagagattactcaaggtccttagcactgattacagagcatatctcagatgccttctgctgaccagatgtatctttgcataatctgcctatccagattcagaaaattgatgccacatagccaagtggactttcaggaacagacgatttaaaaacaggcagagagatgtgagagaaaggagaaggagagagagaagggagagggagagaagagagagggagacggagaaggaaagagggagaaggagaaggagagaaggggcatggacagagggagggacagaaggagagaggagatagagagggggataaggaagaaaggagggagggagagagagagaaggctaagtctttccatacctgggtcccaatacctcttataacccaagcacatggtttcagatatcacaatgcggttgggatatagataactgtaaatacttgtgaaaataatggggctgagatctggggttttcatgatagtttcaaagtcactgtactgactaaaaccttccactggcccatctccagcttgttaatctgagggtatcaaatttcccactaagtgtgtttagaaagatctccacctttttgccctagtcttccagtgccccacctacgttctggtctcccacatctgatgtcttctcagtgattctggccctgcctgctccacagctacaaaccccttcctataatgagctctgtgctgagccatcatcctgaatcaatccaccttaagcagatgttttgcttatttttcctgtgtccatactacagaggaagggtaggcatgtagaagctgaggcatctcatctcactctaagcaccctcagtctctaaatgtgcccctttgtttccagcagttcagcctcaagcatcttttattcactcgtcttagagggacacatgtgctgtagtgttataagatgaaatttaaagcattagttattcccaacaagccaattaaacaagccaaaaacattcatcagtcattcccatggaacctctgaagcatcttcctgctctaaccttgagtttcctagggctgctgtgggatcacaggagctgtcctgtttaccagcctatcctgtcccacgggattcagttattagtgggtgcgagggggaccgcaaacctggaagaaaatgggattggaagagaaaagagaaacgaagaccaagtagatcttttcctatcaaggtcttcgtttattaggctgaggtgcctggtgtaaagcatgcatcgcggggaataggaaggggtcgagggggaattttacaaagaacaaagaagcgggcatctgctgacatgagggccgaagtcaggctccaggcagcggacactctgcatcttatctctggaacatagatcctccttgacagccttggggtgtcaggccaggctcaggtgtaactcatgtccttggatggcatgggagttcaggaagagatagggaagaggggactataattcagcttttacagcctcaggtgccaggaaggcaacagggaggagggagtgactacaggctcctagcacgaggccatttggcctgtcagggtgggagattgtgaagggctcactttctcatggtatggtctctgacaccagccagaaaaaaaaaaaatctccagtcaatctacagaaaggcagaaatatggagaaccttctagaagaacagcaacccttgactgactctgcagggcagtctaagcacacaggttcctctgagcccagtccctggctgtattcactcacacagggcccagcagtctggagatgcctgcagcaggaaggttctcactgtacctcagtctcacagctcagtcactttgtagtctccccacagcaaatcacaaccaatgcagttgtcacccttgaggccattcctcagtgacgcctgggaaacactgtccatttgccctgctcatatgctgtctcagctcacataaattccctccaagctcctttacagaaacaaccaattgacatacaaattaaagtaatatgaagctctgtcctgtaccaattcctagaacacctcagctgctaaaatctaactgtgcaatacagagaactacctagataatacctaactccaatcttgaggtatctgttgaagaggctttcagctatgaattaccaagagggatgcctgtgtctcctacatcttaaggcatctttctgaagctcacactacccttcacagcgccacagcagcagggagatctgtatctcttcctctccacaagagggcagaattcgggtgtcaactgtgacaaccctccagcattaatttctattagtagatattttctttacttacatttcaaatgttatccccttccccagtttttcctccctgaaaccccctatcccatcacccatctccctgctcaccaacccacccattccataagaaccaatcagtaccccacccccccagagctcccagggactaaaccaggaaccaaagagtacacatggaaggacccatagctccagctgcataggtagcactactttgaaaagggggaagatgatgaaatcattactgtgggggaaatgcaaggaagattccaacacatctaggcatctatgaagattttaagtcttcaaaatccaaaaccaccacaaaatttaaaaaaaaaaaaagtagattctaaatgcagtcacctgcaccaggtgcctggggaatcactcagcagccctagactgagaaagcttggagaaagtagaaatagagaaagtgtacagccagtatcctctagctactcacatccaaacagggcctcctgactgctctgagcctgtcctaagaacagcaatgatgccacagaaatttttagagtgagccctgaaggaacttgaggctgatatgagcaagccagtcccagaggaaaggaaaacccatagagagaaaacaggtgagttagtgcattaaaggggctgagcagggagttctcatcgctccccagcaccagaaataagagcctctccggagctgctgggacatggaatgcagatgattcggaccatcagccccacagagacctttcccactctggctcagaaagaggcactggaccacagttggagaggagaatcgaaagctgatatctctgtattcacttagcctgttacccacccatgcacccaagtccaaggtgggagaaacactgagggtctaaacacagccccagagcaactgccagtattaaataccagatttcagaagatgggaaatcacctctctggtcatttttgggacatgtaaactgtaacaggaaacataggaccaatttaagatggagcagtcctatatccctaacccagttgtaaataaaacattcaagagtgccatcagacaccacagtggtacaggagagatgagtgtacctagtgcatcaagagttccctcactagataaaccaagatgtagccccaggaccacccaggcacctaccaggactcccctccagaggtctgagccagttagctctagttcattctatgtttcagaccaaaacatcagaaacaacagcatctccactgcagatgaacccctaagccatacagtgtacccaaaggcagcaccacagatggggaatgtgggggcgaagaagcttgtatcacattaagagtgttgcccaatgactatttgctatcttcacagtaagatgggcactgatcccacccaccaaaacatagtaggacaaggacccttaaataacatctgtcaaggggagctgtcaaatagccactgagctgagatggctcatacggggtgatatagaaaaacaggccaaagaacctcctgtgttgcaagcacaaatgggaagctgtgaatctccactaccttacaagaaaactgtaccaatctgcaagaacaggggatacacagctttccacactgtgtaggaaggcattggactctcagatcatccaaggactagggctaaagtggccatgtgtgggaaatacatccactttataaacctaccttgtatccacatcacacatggagcatctgctcctggtccctacctcatgtgggtgctgcggtgctgtacattgagtctgggggcatgagtgtgcccggtaaattccttatcactcagatgaatttccagtccacactcatcaccttggagtaggaattttaaaagttagtgtagatataagtaaagagagtcaggagggggggctgaaaggcagacctgcagaaattctccagagggtagagctcagaagcagcaagcaaaacttgggctaacagaagagcaaacacagagctcaggcagaactacctggcaatgcgactgggcacactgaaagcactgggcatcagcactgagccccaaatatgcactcaggatcctctgcataataatgtaacataacaggaaggttagaacaggccaaaagaggaaacagaacaaatgcccctaaccaaagaagtataaacaaattgggaagagtaaagaaggattgtaaggattgagtaccacacagaacatgctcttaatggcctcaatgctgaagctaggaagaactaagttaaaagaaacatgttcaacgggattccctgtcactggacttcacaacaagcaaaattcaatctttctgttaaggagatgagaagagaatatctgaaccttgtgttgacagtgccccaccccgactgtcaggctgtgggaaatgccagagcaatcactaggaacacacaaggatgagggagacgagggttaggacacaaccatcatgatatcccacaagtatggaagagcaagaacttgtagagagcagagaatggcagacaaagcagcatatacataagtagatggccagactatacaggaaagatctacatagcctgtgaggctttctgacagaaaagggcaggcatgtctcaaagcacaatgcctggcttgggacactgtctgccctggatcctctcactccacatgtaaggagctcacagcaaaaccacacagccttccacaagaggagaagaaaaggtagcttgtcagtgaggaagtcccccagagacagaccattccagtagttcttatcattcctcccaaagcagccaccatccaggcactgagagaccaaaggctgttgggaggtcagcctagaggcaggctcagacctttcttgctccctaggaccttcctgaaaagatagaagcacagaagtgaataatctggacctcaactcaggatgacaactgaaactcaaccgtgctgcctgggcccccaatgctctctacacctgcaggcgcgcc

We claim:

1. A male mouse having in its germline:
(a) an insertion comprising an unrearranged human genomic sequence comprising a single human $V_H$ gene segment, one or more $D_H$ gene segments, and one or more $J_H$ gene segments, wherein the single human $V_H$ gene segment, one or more $D_H$ gene segments, and one or more $J_H$ gene segments are operably linked to a mouse immunoglobulin constant region gene at the endogenous immunoglobulin heavy chain locus, and wherein the single human $V_H$ gene segment is $V_H$1-69 or a polymorphic variant thereof, wherein the insertion disrupts the function of an endogenous ADAM6 protein, and wherein the disruption of the endogenous ADAM6 function is associated with a reduction in fertility in male mice; and
b) an insertion comprising an ectopic nucleic acid that encodes a mouse ADAM6 protein that is functional in a male mouse, wherein the mouse ADAM6 protein is expressed and the male mouse has wild-type fertility, wherein the sequence that encodes the mouse ADAM6 protein is located between the single human $V_H$ gene segment and the 5' most $D_H$ gene segment; wherein B cells of the mouse express antibodies in response to exposure to an antigen, wherein each antibody includes two immunoglobulin light chains paired with two immunoglobulin heavy chains, wherein each heavy chain comprises a human heavy chain variable domain expressed from a human heavy chain variable region sequence including a $V_H$ gene segment that is identical to, or a somatically hypermutated version of the single human $V_H$ gene segment.

2. The mouse of claim 1, wherein the single human $V_H$ gene segment is a polymorphic variant of $V_H$1-69.

3. The mouse of claim 1, wherein the mouse comprises a deletion of all or substantially all endogenous $V_H$ gene segments.

4. The mouse of claim 1, wherein the unrearranged human genomic sequence comprises a human $V_H$1-69 gene segment, 27 human $D_H$ gene segments, and six human $J_H$ gene segments.

5. The mouse of claim 1 or 4, further comprising one or more human Vκ gene segments and one or more human Jκ gene segments.

6. The mouse of claim 5, wherein the one or more human Vκ gene segments and one or more human Jκ gene segments are present at an endogenous immunoglobulin light chain locus.

7. A male mouse comprising an insertion including an unrearranged human genomic sequence including a single human $V_H$ gene segment operably linked to at least one human $D_H$ gene segment, and at least one human $J_H$ gene segment, wherein the single human $V_H$ gene segment, the at least one human $D_H$ gene segment, and the at least one $J_H$ gene segment are operably linked to a mouse immunoglobulin constant region gene at the endogenous immunoglobulin heavy chain locus, wherein the single human $V_H$ gene segment is $V_H$1-69 or a polymorphic variant thereof, wherein the insertion disrupts the function of an endogenous ADAM6 protein, and wherein the disruption of the endogenous ADAM6 function is associated with a reduction in fertility in male mice; and wherein the mouse comprises a mouse ADAM6 sequence located between the single human $V_H$ gene segment and the 5' most $D_H$ gene segment, wherein the mouse ADAM6 sequence encodes a mouse ADAM6 protein that is functional in a male mouse, wherein the functional mouse ADAM6 protein is expressed and the male mouse has wild-type fertility.

8. The mouse of claim 7, wherein the mouse ADAM6 sequence is present at an ectopic position.

9. A cell or tissue derived from the mouse of claim 1 or 7.

10. A method of generating a rearranged human immunoglobulin heavy chain variable region sequence that encodes a human immunoglobulin heavy chain variable domain, the method comprising
   (a) immunizing the mouse of claim 1 with an antigen of interest;
   (b) allowing said mouse to mount an immune response with respect to the antigen of interest; and
   (c) identifying or isolating a rearranged human immunoglobulin heavy chain variable region sequence that encodes a heavy chain variable domain of an antibody from the mouse that binds the antigen of interest.

11. The method of claim 10, wherein the heavy chain variable domain includes an amino acid sequence encoded by the single human $V_H$ gene segment, wherein the amino acid sequence encoded by the single human $V_H$ gene segment is at least 75% identical to SEQ ID NO: 5.

12. The method of claim 10, wherein the heavy chain variable domain includes an amino acid sequence encoded by the single $V_H$ gene segment, wherein the amino acid sequence encoded by the single human $V_H$ gene segment encodes an amino acid sequence identical to SEQ ID NO: 5.

13. A method for modifying an immunoglobulin heavy chain locus of a mouse, comprising:
   (a) making a first modification of the mouse immunoglobulin heavy chain locus, wherein the first modification comprises an insertion of one or more unrearranged human immunoglobulin gene sequences at the mouse immunoglobulin heavy chain locus, including a single human $V_H$ gene segment, one or more $D_H$ gene segments, and one or more $J_H$ gene segments, wherein the single human $V_H$ gene segment, one or more $D_H$ gene segments, and one or more $J_H$ gene segments are operably linked with a mouse immunoglobulin constant region gene at the endogenous immunoglobulin heavy chain locus, wherein the single human $V_H$ gene segment is $V_H$1-69 or a polymorphic variant thereof, wherein the insertion disrupts the function of an endogenous ADAM6 protein, and wherein the disruption of the endogenous ADAM6 function is associated with a reduction in fertility in male mice; and
   (b) making a second modification of the mouse which comprises an insertion of a mouse ADAM6 sequence between the single human $V_H$ gene segment and the 5' most $D_H$ gene segment, wherein the mouse ADAM6 sequence encodes a mouse ADAM6 protein that is functional in a male mouse, wherein the functional mouse ADAM6 protein is expressed and the male mouse has wild-type fertility.

14. The method of claim 13, wherein the first modification comprises the replacement of one or more sequences in the mouse immunoglobulin heavy chain locus with the one or more unrearranged human immunoglobulin gene sequences.

15. The method of claim 14, wherein the first modification comprises the replacement of one or more endogenous $V_H$ gene segments with the single human $V_H$ gene segment in the endogenous immunoglobulin heavy chain locus.

16. The method of claim 13, wherein the first modification comprises the replacement of an endogenous heavy chain variable gene sequence with the one or more unrearranged human immunoglobulin gene sequences, including the single $V_H$ gene segment, operably linked with the mouse immunoglobulin constant region gene in the endogenous immunoglobulin heavy chain locus.

17. The method of claim 13, wherein the first and the second modification are made simultaneously.

18. A method for generating an antibody specific against an antigen comprising the steps of:
   (a) immunizing the mouse of claim 1 with the antigen;
   (b) isolating at least one cell from the mouse producing an antibody specific against the antigen; and
   (c) culturing the at least one cell producing an antibody of step b) and obtaining said antibody.

19. The method of claim 18, wherein the culturing in step (c) is performed on at least one hybridoma cell generated from the at least one cell obtained in step (b).

20. The method of claim 18, wherein the at least one cell obtained in step (b) is derived from the spleen, a lymph node or bone marrow of the mouse from step (a).

21. The method of claim 18, wherein immunizing with the antigen of step (a) is carried out with protein, DNA, a combination of DNA and protein, or cells expressing the antigen.

22. The method of claim 10, wherein the heavy chain variable domain includes an amino acid sequence encoded by the single human $V_H$ gene segment, wherein the amino acid sequence encoded by the single human $V_H$ gene segment is at least 90% identical to SEQ ID NO: 5.

23. The method of claim 10, wherein the heavy chain variable domain includes an amino acid sequence encoded by the single human $V_H$ gene segment, wherein the amino acid sequence encoded by the single human $V_H$ gene segment is at least 95% identical to SEQ ID NO: 5.

24. The method of claim 10, wherein the heavy chain variable domain includes an amino acid sequence encoded by the single human $V_H$ gene segment, wherein the amino acid sequence encoded by the single human $V_H$ gene segment is at least 98% identical to SEQ ID NO: 5.

25. A method for making a human antigen-binding protein, comprising the steps of:
   (a) exposing a mouse of claim 1 to an antigen of interest;
   (b) allowing the mouse to mount an immune response to the antigen; and
   (c) obtaining from the mouse a heavy chain variable region nucleic acid sequence encoding a human heavy chain variable domain that specifically binds the antigen of interest.

26. The method of claim 25, further comprising the step of (d) fusing the human heavy chain variable region nucleic acid sequence to a human constant region nucleic acid sequence encoding a human heavy chain constant domain.

27. The method of claim 26, further comprising the step of (e) expressing in a mammalian cell an antibody comprising the human heavy chain variable region nucleic acid sequence and the human heavy chain constant region nucleic acid sequence.

\* \* \* \* \*